United States Patent 12,442,020 (MATERIALS AND METHODS FOR TREATMENT OF PAIN RELATED DISORDERS) - sequence listing, part 4

SEQ ID NO: 34226 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
cttgaggggcatatctaggc

SEQ ID NO: 34227 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ggaacttgaggggcatatct

SEQ ID NO: 34228 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tggaacttgaggggcatatc

SEQ ID NO: 34229 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tagagtttgtggaacttgag

SEQ ID NO: 34230 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ttagagtttgtggaacttga

SEQ ID NO: 34231 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
attagagtttgtggaacttg

SEQ ID NO: 34232 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aattagagtttgtggaactt

SEQ ID NO: 34233 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
atatgaaaaattagagtttg

SEQ ID NO: 34234 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
taagagtatatgaaaaatta

SEQ ID NO: 34235 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aataagagtatatgaaaaat

SEQ ID NO: 34236 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aaatgagcgggttaaaataa

SEQ ID NO: 34237 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttaaatgagcgggttaaaat

SEQ ID NO: 34238 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tggcaatcatttaaatgagc

SEQ ID NO: 34239 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
ctggcaatcatttaaatgag

SEQ ID NO: 34240 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tgactggcaatcatttaaat

SEQ ID NO: 34241 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tactagcactggctactgac

SEQ ID NO: 34242 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gtactttttattactagcac

SEQ ID NO: 34243 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
taaatggtactttttattac

SEQ ID NO: 34244 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ctgagttcccagggagtaaa

SEQ ID NO: 34245 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctctattctgagttcccagg

SEQ ID NO: 34246 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tactctattctgagttccca

SEQ ID NO: 34247 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttactctattctgagttccc

SEQ ID NO: 34248 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gttactctattctgagttcc

SEQ ID NO: 34249 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
attagatgttactctattct

SEQ ID NO: 34250 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aatcaatagcccttgttgat

SEQ ID NO: 34251 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gatttagaaagtataatcaa

SEQ ID NO: 34252 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gggtttagggttgatttaga

SEQ ID NO: 34253 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gaaagggtttagggttgatt

SEQ ID NO: 34254 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aagcaaagggaaagggttta

SEQ ID NO: 34255 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aaagcaaagggaaagggttt

SEQ ID NO: 34256 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aaaagcaaagggaaagggtt

SEQ ID NO: 34257 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
agagaaaaagcaaagggaaa

SEQ ID NO: 34258 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aagagaaaaagcaaagggaa

SEQ ID NO: 34259 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaagagaaaaagcaaaggga

SEQ ID NO: 34260 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
agataaagagaaaaagcaaa

SEQ ID NO: 34261 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aagataaagagaaaaagcaa

SEQ ID NO: 34262 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaagataaagagaaaaagca

SEQ ID NO: 34263 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agataaaagataaagagaaa

SEQ ID NO: 34264 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tagtacagataaaagataaa

SEQ ID NO: 34265 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gatagtacagataaaagata

SEQ ID NO: 34266 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cattgtgatagtacagataa

SEQ ID NO: 34267 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tggagaccattgtgatagta

SEQ ID NO: 34268 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
agacttggagaccattgtga

SEQ ID NO: 34269 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
agtggaaacctagagacttg

SEQ ID NO: 34270 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agagtggaaacctagagact

SEQ ID NO: 34271 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aaaatgagagtggaaaccta

SEQ ID NO: 34272 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
acaaaatgagagtggaaacc

SEQ ID NO: 34273 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tggataagacaaaatgagag

SEQ ID NO: 34274 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctgtggataagacaaaatga

SEQ ID NO: 34275 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttctgtggataagacaaaat

SEQ ID NO: 34276 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gtactatatattctgtggat

SEQ ID NO: 34277 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tgacagtactatatattctg

SEQ ID NO: 34278 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atttttaattaccactctga

SEQ ID NO: 34279 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gatgattttttaacagaaga

SEQ ID NO: 34280 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctgatgattttttaacagaa

SEQ ID NO: 34281 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cactgatgattttttaacag

SEQ ID NO: 34282 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
agccactgatgattttttaa

SEQ ID NO: 34283 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
taatcccataagctattgag

SEQ ID NO: 34284 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ggttaatcccataagctatt

SEQ ID NO: 34285 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cccttgtgggttaatcccat

SEQ ID NO: 34286 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cacttaggacaggcccttgt

SEQ ID NO: 34287 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ccacttaggacaggcccttg

SEQ ID NO: 34288 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gggctgggaccacttaggac

SEQ ID NO: 34289 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tgggctgggaccacttagga

SEQ ID NO: 34290 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aaattgggctgggaccactt

SEQ ID NO: 34291 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gaaattgggctgggaccact

SEQ ID NO: 34292 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gagtatcaggaaattgggct

SEQ ID NO: 34293 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tgagtatcaggaaattgggc

SEQ ID NO: 34294 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ggaatgagtatcaggaaatt

SEQ ID NO: 34295 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gggaatgagtatcaggaaat

SEQ ID NO: 34296 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ggtgggtgggaatgagtatc

SEQ ID NO: 34297 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aggtgggtgggaatgagtat

SEQ ID NO: 34298 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctagataggtgggtgggaat

SEQ ID NO: 34299 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tgagtcctagataggtgggt

SEQ ID NO: 34300 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttgagtcctagataggtggg

SEQ ID NO: 34301 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
atcttgagtcctagataggt

SEQ ID NO: 34302 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gatcttgagtcctagatagg

SEQ ID NO: 34303 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
taggatcttgagtcctagat

SEQ ID NO: 34304 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ctaggatcttgagtcctaga

SEQ ID NO: 34305 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ctatctaggatcttgagtcc

SEQ ID NO: 34306 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
agccacctatctaggatctt

SEQ ID NO: 34307 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tggagcatagccacctatct

SEQ ID NO: 34308 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttggagcatagccacctatc

SEQ ID NO: 34309 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
taaaatgccctattggagca

SEQ ID NO: 34310 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
agaattaaaatgccctattg

SEQ ID NO: 34311 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gaagaattaaaatgccctat

SEQ ID NO: 34312 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cttggactggctcctgaggg

SEQ ID NO: 34313 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
actcttggactggctcctga

SEQ ID NO: 34314 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aactcttggactggctcctg

SEQ ID NO: 34315 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aaactcttggactggctcct

SEQ ID NO: 34316 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
taggtttaaaactcttggac

SEQ ID NO: 34317 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agttgtaggtttaaaactct

SEQ ID NO: 34318 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ggtttaagaaaagtagttgt

SEQ ID NO: 34319 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aggtttaagaaaagtagttg

SEQ ID NO: 34320 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ctttggaggtttaagaaaag

SEQ ID NO: 34321 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ctactttggaggtttaagaa

SEQ ID NO: 34322 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ggccactactttggaggttt

SEQ ID NO: 34323 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gcacccggccactactttgg

SEQ ID NO: 34324 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tgcacccggccactactttg

SEQ ID NO: 34325 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
actgcacccggccactactt

SEQ ID NO: 34326 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
cagacgtgagccactgcacc

SEQ ID NO: 34327 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
agtgttgggattacagacgt

SEQ ID NO: 34328 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ctcccaaagtgttgggatta

SEQ ID NO: 34329 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cctctgcctcccaaagtgtt

SEQ ID NO: 34330 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
acctctgcctcccaaagtgt

SEQ ID NO: 34331 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ctgcccacctctgcctccca

SEQ ID NO: 34332 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ggtcttgaacttccgacctc

SEQ ID NO: 34333 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tttctccatgttggtcaggc

SEQ ID NO: 34334 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ggagtttctccatgttggtc

SEQ ID NO: 34335 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tggagtttctccatgttggt

SEQ ID NO: 34336 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gagatggagtttctccatgt

SEQ ID NO: 34337 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tattttttttagtagagatg

SEQ ID NO: 34338 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tgtattttttttagtagaga

SEQ ID NO: 34339 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
attttgtattttttttagta

SEQ ID NO: 34340 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
taattttgtattttttttag

SEQ ID NO: 34341 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ggctaattttgtattttttt

SEQ ID NO: 34342 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
taagcacgcgccaccacgcc

SEQ ID NO: 34343 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttccgaggagccgggattat

SEQ ID NO: 34344 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cctcagccttccgaggagcc

SEQ ID NO: 34345 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
gcctcagccttccgaggagc

SEQ ID NO: 34346 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tcctgcctcagccttccgag

SEQ ID NO: 34347 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tctcctgcctcagccttccg

SEQ ID NO: 34348 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttctcctgcctcagccttcc

SEQ ID NO: 34349 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttcaagcgattctcctgcct

SEQ ID NO: 34350 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
caatctccgctcctgggttc

SEQ ID NO: 34351 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tcaccgcaatctccgctcct

SEQ ID NO: 34352 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ctcaccgcaatctccgctcc

SEQ ID NO: 34353 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
gaagtgcaatggcgtgatct

SEQ ID NO: 34354 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttgcccatcctgaagtgcaa

SEQ ID NO: 34355 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgctcttgttgcccatcctg

SEQ ID NO: 34356 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tttgtttgtttgttttgacg

SEQ ID NO: 34357 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
tgtttgtttgtttgttttga

SEQ ID NO: 34358 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
atgtcaaatcatgatgagag

SEQ ID NO: 34359 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttatgtcaaatcatgatgag

SEQ ID NO: 34360 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
attatgtcaaatcatgatga

SEQ ID NO: 34361 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tgattatgtcaaatcatgat

SEQ ID NO: 34362 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gatggtcacagcttggggga

SEQ ID NO: 34363 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
agatggtcacagcttggggg

SEQ ID NO: 34364 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aagatggtcacagcttgggg

SEQ ID NO: 34365 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ataagatggtcacagcttgg

SEQ ID NO: 34366 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aataagatggtcacagcttg

SEQ ID NO: 34367 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gaataagatggtcacagctt

SEQ ID NO: 34368 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tgaataagatggtcacagct

SEQ ID NO: 34369 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aaagatgaataagatggtca

SEQ ID NO: 34370 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gagtagaaagatgaataaga

SEQ ID NO: 34371 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atgggagtagaaagatgaat

SEQ ID NO: 34372 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gggctaaatatgggagtaga

SEQ ID NO: 34373 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cattgggctaaatatgggag

SEQ ID NO: 34374 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ccccattgggctaaatatgg

SEQ ID NO: 34375 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
taccccattgggctaaatat

SEQ ID NO: 34376 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gtaccccattgggctaaata

SEQ ID NO: 34377 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
taccttctatgtaccccatt

SEQ ID NO: 34378 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttaccttctatgtaccccat

SEQ ID NO: 34379 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aagagtgtatacaactgaat

SEQ ID NO: 34380 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
taaagtaaggaatagagaaa

SEQ ID NO: 34381 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tttaaagtaaggaatagaga

SEQ ID NO: 34382 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tctttttaaagtaaggaata

SEQ ID NO: 34383 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cttctttttaaagtaaggaa

SEQ ID NO: 34384 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gtttccttctttttaaagta

SEQ ID NO: 34385 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgtttccttctttttaaagt

SEQ ID NO: 34386 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tttctgtttccttcttttta

SEQ ID NO: 34387 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
cttttttctttttctttcat

SEQ ID NO: 34388 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ataacaaatacaacagtaaa

SEQ ID NO: 34389 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gaaaatgataacaaatacaa

SEQ ID NO: 34390 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ataaataaaatgagactatt

SEQ ID NO: 34391 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
taaattgaaataaataaaat

SEQ ID NO: 34392 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
cagtagattagtaaaacata

SEQ ID NO: 34393 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
agtggaagtacacagtagat

SEQ ID NO: 34394 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aatgaagtggaagtacacag

SEQ ID NO: 34395 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
caaaatgaagtggaagtaca

SEQ ID NO: 34396 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
taaattgcaaaatgaagtgg

SEQ ID NO: 34397 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tcctaaattgcaaaatgaag

SEQ ID NO: 34398 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tactcctaaattgcaaaatg

SEQ ID NO: 34399 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
attctaattttcagaattaa

SEQ ID NO: 34400 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tgtagagagattctaatttt

SEQ ID NO: 34401 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctaatttaaaagtttgtaga

SEQ ID NO: 34402 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
acctaatttaaaagtttgta

SEQ ID NO: 34403 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tgacctaatttaaaagtttg

SEQ ID NO: 34404 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aatattgtgacctaatttaa

SEQ ID NO: 34405 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
atagtctacttagggttttt

SEQ ID NO: 34406 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tatagtctacttagggtttt

SEQ ID NO: 34407 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ttgcccttatagtctactta

SEQ ID NO: 34408 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
attgcccttatagtctactt

SEQ ID NO: 34409 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cattgcccttatagtctact

SEQ ID NO: 34410 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cttataatgcattgccctta

SEQ ID NO: 34411 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tgttatatacacggcaactc

SEQ ID NO: 34412 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
ctgaggtattgttatataca

SEQ ID NO: 34413 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gagccaccatgcccggtctg

SEQ ID NO: 34414 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tgagccaccatgcccggtct

SEQ ID NO: 34415 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
caggcgtgagccaccatgcc

SEQ ID NO: 34416 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
agtgctgggattacaggcgt

SEQ ID NO: 34417 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttccaaagtgctgggattac

SEQ ID NO: 34418 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cttccaaagtgctgggatta

SEQ ID NO: 34419 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cctcggccttccaaagtgct

SEQ ID NO: 34420 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gcctcggccttccaaagtgc

SEQ ID NO: 34421 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ccacctgcctcggccttcca

SEQ ID NO: 34422 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
ttcaggtgatccacctgcct

SEQ ID NO: 34423 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ggtctcgaactcccgacttc

SEQ ID NO: 34424 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tggtctcgaactcccgactt

SEQ ID NO: 34425 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tttctccatgttggtcagac

SEQ ID NO: 34426 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cagggtttctccatgttggt

SEQ ID NO: 34427 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gagacagggtttctccatgt

SEQ ID NO: 34428 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ttgtatttttagtagagaca

SEQ ID NO: 34429 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tttgtatttttagtagagac

SEQ ID NO: 34430 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttttgtatttttagtagaga

SEQ ID NO: 34431 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctaattttgtatttttagta

SEQ ID NO: 34432 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ggctaattttgtatttttag

SEQ ID NO: 34433 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cctggctaattttgtatttt

SEQ ID NO: 34434 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
caggcatgccccaccacgcc

SEQ ID NO: 34435 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tcctgagtagctgggattac

SEQ ID NO: 34436 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ctcctgagtagctgggatta

SEQ ID NO: 34437 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cctcagcctcctgagtagct

SEQ ID NO: 34438 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gcctcagcctcctgagtagc

SEQ ID NO: 34439 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttctgcctcagcctcctgag

SEQ ID NO: 34440 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttcttctgcctcagcctcct

SEQ ID NO: 34441 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttcaagcaattcttctgcct

SEQ ID NO: 34442 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aacctccgcctcccaggttc

SEQ ID NO: 34443 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cgccacaacctccgcctccc

SEQ ID NO: 34444 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tcgccacaacctccgcctcc

SEQ ID NO: 34445 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ggagtgcaatggcgcaatct

SEQ ID NO: 34446 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttgcccaggctggagtgcaa

SEQ ID NO: 34447 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cactcttgttgcccaggctg

SEQ ID NO: 34448 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttcactcttgttgcccaggc

SEQ ID NO: 34449 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gagtttcactcttgttgccc

SEQ ID NO: 34450 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ggagtttcactcttgttgcc

SEQ ID NO: 34451 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tttattttttttgtgagagg

SEQ ID NO: 34452 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tttttattttttttgtgaga

SEQ ID NO: 34453 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttttttattttttttgtgag

SEQ ID NO: 34454 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
attttttattttttttgtga

SEQ ID NO: 34455 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttattttttattttttttgt

SEQ ID NO: 34456 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aatgagaaatattgcagacc

SEQ ID NO: 34457 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttttcaaatgagaaatattg

SEQ ID NO: 34458 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gagtagaaaagttttcaaat

SEQ ID NO: 34459 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tccacgaaccaggagtagaa

SEQ ID NO: 34460 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
acaagtccacgaaccaggag

SEQ ID NO: 34461 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tagacaagtccacgaaccag

SEQ ID NO: 34462 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tatagacaagtccacgaacc

SEQ ID NO: 34463 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttatagacaagtccacgaac

SEQ ID NO: 34464 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tggcagaggaagttatagac

SEQ ID NO: 34465 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aattatggcagaggaagtta

SEQ ID NO: 34466 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tactttaattatggcagagg

SEQ ID NO: 34467 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
agatactttaattatggcag

SEQ ID NO: 34468 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gagatactttaattatggca

SEQ ID NO: 34469 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cagagatactttaattatgg

SEQ ID NO: 34470 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gcccagagatactttaatta

SEQ ID NO: 34471 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gtaaatgtttttggtgccca

SEQ ID NO: 34472 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttgtaaatgtttttggtgcc

SEQ ID NO: 34473 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agtcattttgtaaatgtttt

SEQ ID NO: 34474 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
attgacatcatagttgaaag

SEQ ID NO: 34475 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tttattgacatcatagttga

SEQ ID NO: 34476 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aaggaattttattgacatca

SEQ ID NO: 34477 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
catagaatttttgtagtata

SEQ ID NO: 34478 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tcatagaatttttgtagtat

SEQ ID NO: 34479 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
atagaatcatagaatttttg

SEQ ID NO: 34480 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
atgcaggaataatagaatca

SEQ ID NO: 34481 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aattatccatgcaggaataa

SEQ ID NO: 34482 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tactggtaaattatccatgc

SEQ ID NO: 34483 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttactggtaaattatccatg

SEQ ID NO: 34484 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
acataaaaagcttgaattac

SEQ ID NO: 34485 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aatctctctccttacataaa

SEQ ID NO: 34486 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttcctggaggggcatcccca

SEQ ID NO: 34487 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tgaaaatgaaattcctggag

SEQ ID NO: 34488 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
atgaaaatgaaattcctgga

SEQ ID NO: 34489 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aatgaaaatgaaattcctgg

SEQ ID NO: 34490 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gaatgaaaatgaaattcctg

SEQ ID NO: 34491 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aagaatgaaaatgaaattcc

SEQ ID NO: 34492 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
taaaggcagaatgcccagac

SEQ ID NO: 34493 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gctgttaaaggcagaatgcc

SEQ ID NO: 34494 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aaagagaaagctgttaaagg

SEQ ID NO: 34495 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cacaaagagaaagctgttaa

SEQ ID NO: 34496 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
acacaaagagaaagctgtta

SEQ ID NO: 34497 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ggacattacacacaaagaga

SEQ ID NO: 34498 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gtggggacattacacacaaa

SEQ ID NO: 34499 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tggtggggacattacacaca

SEQ ID NO: 34500 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tttcatgaaaccaagtggtg

SEQ ID NO: 34501 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gtttcatgaaaccaagtggt

SEQ ID NO: 34502 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agtttcatgaaaccaagtgg

SEQ ID NO: 34503 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
cctagtttcatgaaaccaag

SEQ ID NO: 34504 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atacctagtttcatgaaacc

SEQ ID NO: 34505 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gaggcacatatagggatacc

SEQ ID NO: 34506 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gtgtttctgaggcacatata

SEQ ID NO: 34507 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgtgtttctgaggcacatat

SEQ ID NO: 34508 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttgtgtttctgaggcacata

SEQ ID NO: 34509 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgttgtgttttgtgtttctg

SEQ ID NO: 34510 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttgttgtgttttgtgtttct

SEQ ID NO: 34511 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gcagagatgaagggatggac

SEQ ID NO: 34512 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aatcagcagagatgaaggga

SEQ ID NO: 34513 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ctaaaatcagcagagatgaa

SEQ ID NO: 34514 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cctaaaatcagcagagatga

SEQ ID NO: 34515 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tcctaaaatcagcagagatg

SEQ ID NO: 34516 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctgaattcctaaaatcagca

SEQ ID NO: 34517 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttctgaattcctaaaatcag

SEQ ID NO: 34518 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aatttctgaattcctaaaat

SEQ ID NO: 34519 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atttcattagtgaattacta

SEQ ID NO: 34520 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tatcatttacaaaatttcat

SEQ ID NO: 34521 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atagttaaataaataatagg

SEQ ID NO: 34522 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ggcatagttaaataaataat

SEQ ID NO: 34523 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gggcatagttaaataaataa

SEQ ID NO: 34524 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gtctaggataatagtgggca

SEQ ID NO: 34525 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aatgtgtctaggataatagt

SEQ ID NO: 34526 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
caatgtgtctaggataatag

SEQ ID NO: 34527 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
attcaatgtgtctaggataa

SEQ ID NO: 34528 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gagctcaattcaatgtgtct

SEQ ID NO: 34529 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
agagctcaattcaatgtgtc

SEQ ID NO: 34530 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
atttacagacaaaattctaa

SEQ ID NO: 34531 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttatttacagacaaaattct

SEQ ID NO: 34532 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atagttctaattcttattta

SEQ ID NO: 34533 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aaaagtgacctcataaaata

SEQ ID NO: 34534 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atcattgatgactaagttaa

SEQ ID NO: 34535 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
acatggaatcattgatgact

SEQ ID NO: 34536 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agagaatgtgtttacaaaca

SEQ ID NO: 34537 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
agtgggcaagatgattgaca

SEQ ID NO: 34538 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ccagtgggcaagatgattga

SEQ ID NO: 34539 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cctggtgatcaccagtgggc

SEQ ID NO: 34540 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tttccctggtgatcaccagt

SEQ ID NO: 34541 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttttccctggtgatcaccag

SEQ ID NO: 34542 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gccttttccctggtgatcac

SEQ ID NO: 34543 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ataaccttttgccttttccc

SEQ ID NO: 34544 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
atacttaaaatgttcttttt

SEQ ID NO: 34545 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
attttaatacacatgcaact

SEQ ID NO: 34546 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
taattcctgtttcttactct

SEQ ID NO: 34547 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tagcattcgctttatatttg

SEQ ID NO: 34548 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aaaaaaagtcaccgtcaaaa

SEQ ID NO: 34549 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttttaaaaatattataaaaa

SEQ ID NO: 34550 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttactcttagcactctgaaa

SEQ ID NO: 34551 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gagagcaggcaaattactct

SEQ ID NO: 34552 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgtgcttatatatagagagc

SEQ ID NO: 34553 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ctgtgcttatatatagagag

SEQ ID NO: 34554 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cgtctgtgcttatatataga

SEQ ID NO: 34555 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tgcgtctgtgcttatatata

SEQ ID NO: 34556 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tgtgcgtctgtgcttatata

SEQ ID NO: 34557 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aatgtcttaagtgtctactt

SEQ ID NO: 34558 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gaatgtcttaagtgtctact

SEQ ID NO: 34559 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aacttagatatgaatgtctt

SEQ ID NO: 34560 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aatcagatttttttaaaact

SEQ ID NO: 34561 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aagcctttgtgtcgccaaat

SEQ ID NO: 34562 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttgttaaattcttcccttgg

SEQ ID NO: 34563 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
attttgttaaattcttccct

SEQ ID NO: 34564 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttttcatgcttcaagacttc

SEQ ID NO: 34565 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttttaggcttttcatgcttc

SEQ ID NO: 34566 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tttgtattattcttcttttt

SEQ ID NO: 34567 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttttgtattattcttctttt

SEQ ID NO: 34568 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
atttcaccaccctgatgtgt

SEQ ID NO: 34569 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
catttcaccaccctgatgtg

SEQ ID NO: 34570 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgtggttgataaactttata

SEQ ID NO: 34571 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gtgtggttgataaactttat

SEQ ID NO: 34572 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
taaaccataaagtaattgtg

SEQ ID NO: 34573 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ataattttatataaaccata

SEQ ID NO: 34574 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttttcatgataagttgtatg

SEQ ID NO: 34575 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ggaagcaattttttcatgat

SEQ ID NO: 34576 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttcctcagctcagttgcagg

SEQ ID NO: 34577 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aaattcctcagctcagttgc

SEQ ID NO: 34578 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
taaattcctcagctcagttg

SEQ ID NO: 34579 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
catccctaaattcctcagct

SEQ ID NO: 34580 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
catatcatccctaaattcct

SEQ ID NO: 34581 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cccacatcttttgcttgaaa

SEQ ID NO: 34582 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gagccatgaagatattgcaa

SEQ ID NO: 34583 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cttttggcaagagagccatg

SEQ ID NO: 34584 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
acatcagtcttttggcaaga

SEQ ID NO: 34585 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
atacatcagtcttttggcaa

SEQ ID NO: 34586 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atatacatcagtcttttggc

SEQ ID NO: 34587 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttaaatatacatcagtcttt

SEQ ID NO: 34588 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
taaagtgattaaatatacat

SEQ ID NO: 34589 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gaaatcacatccattagata

SEQ ID NO: 34590 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
actttagaaatcacatccat

SEQ ID NO: 34591 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ctaatggctaactgtgactt

SEQ ID NO: 34592 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
cagagcaagagctttcctaa

SEQ ID NO: 34593 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gctcagctgaaccagagcaa

SEQ ID NO: 34594 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gtgctcagctgaaccagagc

SEQ ID NO: 34595 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cagagtgctcagctgaacca

SEQ ID NO: 34596 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atcagagtgctcagctgaac

SEQ ID NO: 34597 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ggaaatgtaatcagagtgct

SEQ ID NO: 34598 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aaagtcaggaaatgtaatca

SEQ ID NO: 34599 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
acaaagtcaggaaatgtaat

SEQ ID NO: 34600 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttctctgaaaccacaaagtc

SEQ ID NO: 34601 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cttctctgaaaccacaaagt

SEQ ID NO: 34602 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tctgcttctctgaaaccaca

SEQ ID NO: 34603 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ccagccagggaattctccac

SEQ ID NO: 34604 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aagactgatgaatccagcca

SEQ ID NO: 34605 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aaagactgatgaatccagcc

SEQ ID NO: 34606 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
caaagactgatgaatccagc

SEQ ID NO: 34607 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atagcaaagactgatgaatc

SEQ ID NO: 34608 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gtattctcttgtccatagca

SEQ ID NO: 34609 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttactgtattctcttgtcca

SEQ ID NO: 34610 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
cccaagactaatgacttgga

SEQ ID NO: 34611 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aacccccaagactaatgact

SEQ ID NO: 34612 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agtgaatctacccaaccccc

SEQ ID NO: 34613 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tggctctaaagacttggatg

SEQ ID NO: 34614 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ggcacttggctctaaagact

SEQ ID NO: 34615 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
catatgggcacttggctcta

SEQ ID NO: 34616 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aagttagccatatgggcact

SEQ ID NO: 34617 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gtaattaaagttagccatat

SEQ ID NO: 34618 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agtaattaaagttagccata

SEQ ID NO: 34619 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tgttctatagtaattaaagt

SEQ ID NO: 34620 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aatctgttctatagtaatta

SEQ ID NO: 34621 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gggaaaaaaaatctgttcta

SEQ ID NO: 34622 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tcaagaagggtaagaatttg

SEQ ID NO: 34623 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
atcaagaagggtaagaattt

SEQ ID NO: 34624 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aatcaagaagggtaagaatt

SEQ ID NO: 34625 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ccaatctaatcaagaagggt

SEQ ID NO: 34626 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gtttccaatctaatcaagaa

SEQ ID NO: 34627 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgtttccaatctaatcaaga

SEQ ID NO: 34628 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttgtttccaatctaatcaag

SEQ ID NO: 34629 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gatttgtttccaatctaatc

SEQ ID NO: 34630 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
attatttaaaactccataat

SEQ ID NO: 34631 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gttgatgatgatgagcttca

SEQ ID NO: 34632 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ggtatcaggttgatgatgat

SEQ ID NO: 34633 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
acatattcttagatggtatc

SEQ ID NO: 34634 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aacatattcttagatggtat

SEQ ID NO: 34635 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
cacataaacatattcttaga

SEQ ID NO: 34636 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tttgcacataaacatattct

SEQ ID NO: 34637 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
acttgaatttaaattttttc

SEQ ID NO: 34638 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttttttactgtatcttacaa

SEQ ID NO: 34639 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
agtctatttgtgatatattc

SEQ ID NO: 34640 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atagaatgaagacaataggg

SEQ ID NO: 34641 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gccatagaatgaagacaata

SEQ ID NO: 34642 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cgccatagaatgaagacaat

SEQ ID NO: 34643 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
acgccatagaatgaagacaa

SEQ ID NO: 34644 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttaagaaacgccatagaatg

SEQ ID NO: 34645 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gtgtttcttaagaaacgcca

SEQ ID NO: 34646 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
taacattgtacgtgtttctt

SEQ ID NO: 34647 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cttattttttttgagatgtc

SEQ ID NO: 34648 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gtttagggcttatttttttt

SEQ ID NO: 34649 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ctccccattttacgggttta

SEQ ID NO: 34650 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tctccccattttacgggttt

SEQ ID NO: 34651 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttctccccattttacgggtt

SEQ ID NO: 34652 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gttttttctccccattttac

SEQ ID NO: 34653 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
agttttttctccccatttta

SEQ ID NO: 34654 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttaccaatataccaacttta

SEQ ID NO: 34655 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
actgtcattcacattataat

SEQ ID NO: 34656 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tactgtcattcacattataa

SEQ ID NO: 34657 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ctgtcaggctgttaaaagta

SEQ ID NO: 34658 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tctgtcaggctgttaaaagt

SEQ ID NO: 34659 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttctgtcaggctgttaaaag

SEQ ID NO: 34660 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
attttctgtcaggctgttaa

SEQ ID NO: 34661 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tctactgtaaattttctgtc

SEQ ID NO: 34662 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atctactgtaaattttctgt

SEQ ID NO: 34663 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
agataaatccatgagtagta

SEQ ID NO: 34664 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aagtcagataaatccatgag

SEQ ID NO: 34665 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cataagtcagataaatccat

SEQ ID NO: 34666 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aaggggaatcatccataagt

SEQ ID NO: 34667 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tttaaaggggaatcatccat

SEQ ID NO: 34668 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gaatagaacagtctttaaag

SEQ ID NO: 34669 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tgaatagaacagtctttaaa

SEQ ID NO: 34670 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttgaatagaacagtctttaa

SEQ ID NO: 34671 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
attgaatagaacagtcttta

SEQ ID NO: 34672 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
taaaactttattgaatagaa

SEQ ID NO: 34673 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gcatgtaaaactttattgaa

SEQ ID NO: 34674 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agcaaaggaatgcatacaac

SEQ ID NO: 34675 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tatttctggtcttgtagcaa

SEQ ID NO: 34676 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttatttctggtcttgtagca

SEQ ID NO: 34677 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
atgctttatttctggtcttg

SEQ ID NO: 34678 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
attgtataatgctttatttc

SEQ ID NO: 34679 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tatctttttaacttgttatt

SEQ ID NO: 34680 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tcaccatcattaatttacca

SEQ ID NO: 34681 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ctgcagtctgcttttattgt

SEQ ID NO: 34682 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
actgcagtctgcttttattg

SEQ ID NO: 34683 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tcttagtttcagtcttactg

SEQ ID NO: 34684 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cttatttggtttcttagttt

SEQ ID NO: 34685 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
taatgccttatttggtttct

SEQ ID NO: 34686 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gtccttgctaatgccttatt

SEQ ID NO: 34687 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
atacttcagtacagaatgta

SEQ ID NO: 34688 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tatacttcagtacagaatgt

SEQ ID NO: 34689 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aatatttctatacttcagta

SEQ ID NO: 34690 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
taaataatatttctatactt

SEQ ID NO: 34691 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgattgatgttttgtgattg

SEQ ID NO: 34692 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaggtgcatatacgaaaagc

SEQ ID NO: 34693 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aatgaaggtgcatatacgaa

SEQ ID NO: 34694 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gttcattaagagtctaatga

SEQ ID NO: 34695 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agttcattaagagtctaatg

SEQ ID NO: 34696 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
atttttaatcagttcattaa

SEQ ID NO: 34697 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
acatttttaatcagttcatt

SEQ ID NO: 34698 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttggagaaaacatttttaat

SEQ ID NO: 34699 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aagaaaaaattaacccattg

SEQ ID NO: 34700 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ctaagaaaaaattaacccat

SEQ ID NO: 34701 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cccacaatgttactgcaact

SEQ ID NO: 34702 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gtatcttgatcagtatatag

SEQ ID NO: 34703 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aaagtatcttgatcagtata

SEQ ID NO: 34704 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tgtaggaaaagtatcttgat

SEQ ID NO: 34705 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tcttatgctgtgtgtaggaa

SEQ ID NO: 34706 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tatcttcttatgctgtgtgt

SEQ ID NO: 34707 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
atatcttcttatgctgtgtg

SEQ ID NO: 34708 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tttcagtttgattaacgtgg

SEQ ID NO: 34709 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
acttttcagtttgattaacg

SEQ ID NO: 34710 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gaattccttgtcttactttt

SEQ ID NO: 34711 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttctaaaataggctctgatt

SEQ ID NO: 34712 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aatgctcatagttctaaaat

SEQ ID NO: 34713 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gaatgctcatagttctaaaa

SEQ ID NO: 34714 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cgttttcagttgaatgctca

SEQ ID NO: 34715 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gaaatctggagacccgtttt

SEQ ID NO: 34716 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tggagcagcacagaaatctg

SEQ ID NO: 34717 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aatggagcagcacagaaatc

SEQ ID NO: 34718 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ggcaacagaatggagcagca

SEQ ID NO: 34719 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttggtggcaacagaatggag

SEQ ID NO: 34720 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttgttggtggcaacagaatg

SEQ ID NO: 34721 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aattgttggtggcaacagaa

SEQ ID NO: 34722 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttatcaattgttggtggcaa

SEQ ID NO: 34723 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
taccaattatcaattgttgg

SEQ ID NO: 34724 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tgataccaattatcaattgt

SEQ ID NO: 34725 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
caagttaaaaagcactaaca

SEQ ID NO: 34726 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tcaagttaaaaagcactaac

SEQ ID NO: 34727 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cttcaaacactcaagttaaa

SEQ ID NO: 34728 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttgaacaacttcaaacactc

SEQ ID NO: 34729 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aaatcttggtttagagaaaa

SEQ ID NO: 34730 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aacttttaaatcttggttta

SEQ ID NO: 34731 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ggaacttttaaatcttggtt

SEQ ID NO: 34732 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
atcctggaacttttaaatct

SEQ ID NO: 34733 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
caatggaaagatatcgatcc

SEQ ID NO: 34734 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaaaaaacagatacaatgga

SEQ ID NO: 34735 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
taaaaaaaaaacagatacaa

SEQ ID NO: 34736 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gaaagaaattaaaaaaaaaa

SEQ ID NO: 34737 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tttgtgatgttttaataaga

SEQ ID NO: 34738 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gaaatttgtgatgttttaat

SEQ ID NO: 34739 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aagcacagatcttttttcaa

SEQ ID NO: 34740 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gccaccacgcccagaaagca

SEQ ID NO: 34741 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cattagccaccacgcccaga

SEQ ID NO: 34742 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cagacattagccaccacgcc

SEQ ID NO: 34743 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
agtgctgggattacagacat

SEQ ID NO: 34744 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ctcccaaagtgctgggatta

SEQ ID NO: 34745 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cttcggcctcccaaagtgct

SEQ ID NO: 34746 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
acttcggcctcccaaagtgc

SEQ ID NO: 34747 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ctgcccacttcggcctccca

SEQ ID NO: 34748 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
ctcaagtgatctgcccactt

SEQ ID NO: 34749 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ggacttgaactcctgacctc

SEQ ID NO: 34750 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tttcatcatgttggtcaggc

SEQ ID NO: 34751 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ggggtttcatcatgttggtc

SEQ ID NO: 34752 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aggggtttcatcatgttggt

SEQ ID NO: 34753 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gggaaggggtttcatcatgt

SEQ ID NO: 34754 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tttgtatttttgaagggaag

SEQ ID NO: 34755 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ttttgtatttttgaagggaa

SEQ ID NO: 34756 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tttttgtatttttgaaggga

SEQ ID NO: 34757 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atttttgtatttttgaaggg

SEQ ID NO: 34758 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
actatttttgtatttttgaa

SEQ ID NO: 34759 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cactatttttgtatttttga

SEQ ID NO: 34760 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tcactatttttgtatttttg

SEQ ID NO: 34761 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tttttttttttttggaaaca

SEQ ID NO: 34762 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttttttttttttttggaaac

SEQ ID NO: 34763 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cttttttttttttttggaaa

SEQ ID NO: 34764 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttttctcttttttttttttt

SEQ ID NO: 34765 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
taaggcatttttttgtagca

SEQ ID NO: 34766 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tgttttaaggcatttttttg

SEQ ID NO: 34767 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttaggcaactaaatgtttta

SEQ ID NO: 34768 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gttaggcaactaaatgtttt

SEQ ID NO: 34769 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
attcaaacttgcttggtgtt

SEQ ID NO: 34770 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tattcaaacttgcttggtgt

SEQ ID NO: 34771 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ataatttattcaaacttgct

SEQ ID NO: 34772 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aatttcctattgcagacaaa

SEQ ID NO: 34773 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aaatttcctattgcagacaa

SEQ ID NO: 34774 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
caaatttcctattgcagaca

SEQ ID NO: 34775 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gattatcaaatttcctattg

SEQ ID NO: 34776 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aatttttttttagtcatggg

SEQ ID NO: 34777 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tataatttttttttagtcat

SEQ ID NO: 34778 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttataatttttttttagtca

SEQ ID NO: 34779 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tgtagattataatttttttt

SEQ ID NO: 34780 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ctgtacatagtggggagctg

SEQ ID NO: 34781 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gttattctgtacatagtggg

SEQ ID NO: 34782 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aggttattctgtacatagtg

SEQ ID NO: 34783 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
caggttattctgtacatagt

SEQ ID NO: 34784 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
acaggttattctgtacatag

SEQ ID NO: 34785 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
atgacaggttattctgtaca

SEQ ID NO: 34786 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgacagaccaaagacatgac

SEQ ID NO: 34787 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atgacagaccaaagacatga

SEQ ID NO: 34788 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaaccttctatgacagacca

SEQ ID NO: 34789 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gttagtaaaaccttctatga

SEQ ID NO: 34790 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
agaggctgtcagcatcaggt

SEQ ID NO: 34791 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cagaagaggctgtcagcatc

SEQ ID NO: 34792 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
acagaagaggctgtcagcat

SEQ ID NO: 34793 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
agggaaacagaagaggctgt

SEQ ID NO: 34794 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgcaaatagggaaacagaag

SEQ ID NO: 34795 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctgcaaatagggaaacagaa

SEQ ID NO: 34796 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gactgcaaatagggaaacag

SEQ ID NO: 34797 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gtagactgcaaatagggaaa

SEQ ID NO: 34798 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tggaatgtagactgcaaata

SEQ ID NO: 34799 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ctggaatgtagactgcaaat

SEQ ID NO: 34800 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gctggaatgtagactgcaaa

SEQ ID NO: 34801 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
agaataatgtagctggaatg

SEQ ID NO: 34802 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
taaacgtagaataatgtagc

SEQ ID NO: 34803 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aaattaaacgtagaataatg

SEQ ID NO: 34804 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
acctttggggaaattaaacg

SEQ ID NO: 34805 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aattatctagctgacctttg

SEQ ID NO: 34806 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aaattatctagctgaccttt

SEQ ID NO: 34807 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gaaattatctagctgacctt

SEQ ID NO: 34808 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
atgaggatgcagaaattatc

SEQ ID NO: 34809 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aagggaacattatgaggatg

SEQ ID NO: 34810 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cagataaagggaacattatg

SEQ ID NO: 34811 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tcagataaagggaacattat

SEQ ID NO: 34812 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gttgaaactgttcagataaa

SEQ ID NO: 34813 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
agttgaaactgttcagataa

SEQ ID NO: 34814 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tagttgaaactgttcagata

SEQ ID NO: 34815 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tcaggatagttgaaactgtt

SEQ ID NO: 34816 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aagtaatcaggtgatcagga

SEQ ID NO: 34817 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aagcaagtaatcaggtgatc

SEQ ID NO: 34818 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aaagcaagtaatcaggtgat

SEQ ID NO: 34819 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
atattacaaagcaagtaatc

SEQ ID NO: 34820 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aatattacaaagcaagtaat

SEQ ID NO: 34821 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgagccaaatattacaaagc

SEQ ID NO: 34822 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gtattgagccaaatattaca

SEQ ID NO: 34823 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cttttcatacaagaggtatt

SEQ ID NO: 34824 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gtcagatcttttcatacaag

SEQ ID NO: 34825 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
agtcagatcttttcatacaa

SEQ ID NO: 34826 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gaagtcagatcttttcatac

SEQ ID NO: 34827 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gggaaggaaggaggcgaagt

SEQ ID NO: 34828 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttgagggaaggaaggaggcg

SEQ ID NO: 34829 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tatatttgagggaaggaagg

SEQ ID NO: 34830 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttatatttgagggaaggaag

SEQ ID NO: 34831 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
atttatatttgagggaagga

SEQ ID NO: 34832 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aatttatatttgagggaagg

SEQ ID NO: 34833 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttgaatttatatttgaggga

SEQ ID NO: 34834 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gttgaatttatatttgaggg

SEQ ID NO: 34835 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
agggttgaatttatatttga

SEQ ID NO: 34836 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aagggttgaatttatatttg

SEQ ID NO: 34837 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gaagggttgaatttatattt

SEQ ID NO: 34838 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gagaaagagaagctgatgaa

SEQ ID NO: 34839 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ggagaaagagaagctgatga

SEQ ID NO: 34840 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gggagaaagagaagctgatg

SEQ ID NO: 34841 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tggagatatgggagaaagag

SEQ ID NO: 34842 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gactggagatatgggagaaa

SEQ ID NO: 34843 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cagactggagatatgggaga

SEQ ID NO: 34844 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aaagcagactggagatatgg

SEQ ID NO: 34845 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tcaaagcagactggagatat

SEQ ID NO: 34846 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ctcaaagcagactggagata

SEQ ID NO: 34847 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tggcagctcaaagcagactg

SEQ ID NO: 34848 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gctggcagctcaaagcagac

SEQ ID NO: 34849 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ggactgctggcagctcaaag

SEQ ID NO: 34850 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aggggactgctggcagctca

SEQ ID NO: 34851 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cgcatttaggggactgctgg

SEQ ID NO: 34852 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
atccgcatttaggggactgc

SEQ ID NO: 34853 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ggataaaaatccgcatttag

SEQ ID NO: 34854 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aggataaaaatccgcattta

SEQ ID NO: 34855 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
taggataaaaatccgcattt

SEQ ID NO: 34856 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gtaggataaaaatccgcatt

SEQ ID NO: 34857 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aaataaagcactgtagaagt

SEQ ID NO: 34858 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gaaataaagcactgtagaag

SEQ ID NO: 34859 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaagaaataaagcactgtag

SEQ ID NO: 34860 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
atgaaagaaataaagcactg

SEQ ID NO: 34861 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
caggcgtgatgaaagaaata

SEQ ID NO: 34862 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gaaggagacaggcgtgatga

SEQ ID NO: 34863 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ggaatctagttgaaggagac

SEQ ID NO: 34864 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tggaatctagttgaaggaga

SEQ ID NO: 34865 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
agtttggaatctagttgaag

SEQ ID NO: 34866 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gaagtttggaatctagttga

SEQ ID NO: 34867 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgaagtttggaatctagttg

SEQ ID NO: 34868 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tgtctatgaagtttggaatc

SEQ ID NO: 34869 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aatttcctgtctatgaagtt

SEQ ID NO: 34870 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agacaaatttcctgtctatg

SEQ ID NO: 34871 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cttggtgataatacatgcct

SEQ ID NO: 34872 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ccagatatcatgttatacct

SEQ ID NO: 34873 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aacaattttatatgatgtgc

SEQ ID NO: 34874 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tttcaccatcttcattcatc

SEQ ID NO: 34875 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tcaagtgcttgggttaggag

SEQ ID NO: 34876 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tcttcaagtgcttgggttag

SEQ ID NO: 34877 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cttcttcaagtgcttgggtt

SEQ ID NO: 34878 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gcttcttcaagtgcttgggt

SEQ ID NO: 34879 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gcgtgcttcttcaagtgctt

SEQ ID NO: 34880 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agcgtgcttcttcaagtgct

SEQ ID NO: 34881 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
attagatagcgtgcttcttc

SEQ ID NO: 34882 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttaaaggcaatataattaga

SEQ ID NO: 34883 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tatgttaaaggcaatataat

SEQ ID NO: 34884 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tagtgtgacatctatgttaa

SEQ ID NO: 34885 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttagtgtgacatctatgtta

SEQ ID NO: 34886 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
taattaaaattgtcttaaat

SEQ ID NO: 34887 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cttggaacactgaaaaatct

SEQ ID NO: 34888 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
taaatgtttgaagatgctct

SEQ ID NO: 34889 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tggattattgtaaatgtttg

SEQ ID NO: 34890 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tgtaaaatcaatgatagtta

SEQ ID NO: 34891 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttctgatgtaaaatcaatga

SEQ ID NO: 34892 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
agagtgccataaattaaaga

SEQ ID NO: 34893 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
attgagagtgccataaatta

SEQ ID NO: 34894 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aggagaaaaagagcaattga

SEQ ID NO: 34895 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tgaggagaaaaagagcaatt

SEQ ID NO: 34896 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttttttaatgaggagaaaaa

SEQ ID NO: 34897 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atttttttaatgaggagaaa

SEQ ID NO: 34898 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gttttaatttttttaatgag

SEQ ID NO: 34899 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
atgttttaatttttttaatg

SEQ ID NO: 34900 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aatgttttaatttttttaat

SEQ ID NO: 34901 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tatcagcctccataaaagga

SEQ ID NO: 34902 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cacatatcagcctccataaa

SEQ ID NO: 34903 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gcacatatcagcctccataa

SEQ ID NO: 34904 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cttatattttttgcacatat

SEQ ID NO: 34905 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ggggaaacaggttgtaatag

SEQ ID NO: 34906 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aatggggaaacaggttgtaa

SEQ ID NO: 34907 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgtcactaaaatggggaaac

SEQ ID NO: 34908 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atgtcactaaaatggggaaa

SEQ ID NO: 34909 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
atttcgatgtcactaaaatg

SEQ ID NO: 34910 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tatttcgatgtcactaaaat

SEQ ID NO: 34911 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gtatttcgatgtcactaaaa

SEQ ID NO: 34912 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tttaattaaacctaagcaga

SEQ ID NO: 34913 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ctactttaattaaacctaag

SEQ ID NO: 34914 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aagctactttaattaaacct

SEQ ID NO: 34915 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tttatggctggggaaaaaaa

SEQ ID NO: 34916 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aaccttcctgtttatggctg

SEQ ID NO: 34917 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
taaccttcctgtttatggct

SEQ ID NO: 34918 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttaaccttcctgtttatggc

SEQ ID NO: 34919 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
acttttaaccttcctgttta

SEQ ID NO: 34920 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agagaattttaaactttagt

SEQ ID NO: 34921 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aattagagaattttaaactt

SEQ ID NO: 34922 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
atttgtgtaatcccaaatta

SEQ ID NO: 34923 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ggatttgtgtaatcccaaat

SEQ ID NO: 34924 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gctgtgaacttaaaaacttt

SEQ ID NO: 34925 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tgctgtgaacttaaaaactt

SEQ ID NO: 34926 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aatgtgcctaatgtattttt

SEQ ID NO: 34927 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
attttaaggtgcttaagtac

SEQ ID NO: 34928 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tctacaattttaaggtgctt

SEQ ID NO: 34929 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ataaaatatctacaatttta

SEQ ID NO: 34930 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aataaaatatctacaatttt

SEQ ID NO: 34931 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttgttggatgttcaaagatt

SEQ ID NO: 34932 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atcgctttgttggatgttca

SEQ ID NO: 34933 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
taaatacttgatcgctttgt

SEQ ID NO: 34934 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ctaggattgtatctgtgcct

SEQ ID NO: 34935 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tctaggattgtatctgtgcc

SEQ ID NO: 34936 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttagggttaatcaaccatct

SEQ ID NO: 34937 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gttagggttaatcaaccatc

SEQ ID NO: 34938 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
taatggcaaaaattaagtta

SEQ ID NO: 34939 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttaatggcaaaaattaagtt

SEQ ID NO: 34940 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tttaatggcaaaaattaagt

SEQ ID NO: 34941 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ctattttaatggcaaaaatt

SEQ ID NO: 34942 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aactgcataaactattttaa

SEQ ID NO: 34943 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tctccctgttatttgcgtac

SEQ ID NO: 34944 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gaaatgaaatcttttcagta

SEQ ID NO: 34945 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
taatggaaatgaaatctttt

SEQ ID NO: 34946 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
taaatgtgtcttggatttaa

SEQ ID NO: 34947 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttctgcaaataaatgtgtct

SEQ ID NO: 34948 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ccatattaataaccccaaat

SEQ ID NO: 34949 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttatttttttctatgctttt

SEQ ID NO: 34950 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
atcagtaattttcttggaat

SEQ ID NO: 34951 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aatcagtaattttcttggaa

SEQ ID NO: 34952 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aaaaaaatcagtaattttct

SEQ ID NO: 34953 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gtctctttaaaaaaaaaaat

SEQ ID NO: 34954 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cacagcctgggtaacagtag

SEQ ID NO: 34955 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
accacagcctgggtaacagt

SEQ ID NO: 34956 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
caccacagcctgggtaacag

SEQ ID NO: 34957 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttgcaccacagcctgggtaa

SEQ ID NO: 34958 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ctatgattgcaccacagcct

SEQ ID NO: 34959 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gctatgattgcaccacagcc

SEQ ID NO: 34960 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
agtcagctatgattgcacca

SEQ ID NO: 34961 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tgaggtttggaggttgcagt

SEQ ID NO: 34962 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cccatgaggtttggaggttg

SEQ ID NO: 34963 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cttgagcccatgaggtttgg

SEQ ID NO: 34964 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
acttgagcccatgaggtttg

SEQ ID NO: 34965 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
acacttgagcccatgaggtt

SEQ ID NO: 34966 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gaagaacacttgagcccatg

SEQ ID NO: 34967 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ggaagaacacttgagcccat

SEQ ID NO: 34968 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctgaggtgggaagaacactt

SEQ ID NO: 34969 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
acttgggaggctgaggtggg

SEQ ID NO: 34970 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gctacttgggaggctgaggt

SEQ ID NO: 34971 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agctacttgggaggctgagg

SEQ ID NO: 34972 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cctagctacttgggaggctg

SEQ ID NO: 34973 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tcctagctacttgggaggct

SEQ ID NO: 34974 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgtagtcctagctacttggg

SEQ ID NO: 34975 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctgtagtcctagctacttgg

SEQ ID NO: 34976 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
acctgtagtcctagctactt

SEQ ID NO: 34977 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
cacctgtagtcctagctact

SEQ ID NO: 34978 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gtggtgcacacctgtagtcc

SEQ ID NO: 34979 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gacatagtggtgcacacctg

SEQ ID NO: 34980 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aaaaaattagccagacatag

SEQ ID NO: 34981 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aaaaaaaaattagccagaca

SEQ ID NO: 34982 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cattaaaaaaaaaaattagc

SEQ ID NO: 34983 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
actccattaaaaaaaaaaat

SEQ ID NO: 34984 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tccagcctgggtgacagaga

SEQ ID NO: 34985 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
actccagcctgggtgacaga

SEQ ID NO: 34986 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gcactccagcctgggtgaca

SEQ ID NO: 34987 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ctgcactccagcctgggtga

SEQ ID NO: 34988 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
atatcactgcactccagcct

SEQ ID NO: 34989 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
catatcactgcactccagcc

SEQ ID NO: 34990 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gagatcatatcactgcactc

SEQ ID NO: 34991 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttgcagtgatggagtgagcc

SEQ ID NO: 34992 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
agaggttgcagtgatggagt

SEQ ID NO: 34993 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aggcagaggttgcagtgatg

SEQ ID NO: 34994 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agaggcagaggttgcagtga

SEQ ID NO: 34995 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ctgccaagaggcagaggttg

SEQ ID NO: 34996 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ccagtgctgccaagaggcag

SEQ ID NO: 34997 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cccagtgctgccaagaggca

SEQ ID NO: 34998 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atcccagtgctgccaagagg

SEQ ID NO: 34999 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gttatcccagtgctgccaag

SEQ ID NO: 35000 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tgttatcccagtgctgccaa

SEQ ID NO: 35001 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cctgttatcccagtgctgcc

SEQ ID NO: 35002 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gtggctcatgcctgttatcc

SEQ ID NO: 35003 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agaagacaggttgggtgtgg

SEQ ID NO: 35004 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aaaagaagacaggttgggtg

SEQ ID NO: 35005 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tatataaaagaagacaggtt

SEQ ID NO: 35006 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
atatataaaagaagacaggt

SEQ ID NO: 35007 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
atatatatataaaagaagac

SEQ ID NO: 35008 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tatatatatataaaagaaga

SEQ ID NO: 35009 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tatgtatatatatataaaag

SEQ ID NO: 35010 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cagtatgtatatatatataa

SEQ ID NO: 35011 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cctttctggaaacattttgt

SEQ ID NO: 35012 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
atacatttttatagcctttc

SEQ ID NO: 35013 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aaaaatgatatacattttta

SEQ ID NO: 35014 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
atgactatacttaacattgt

SEQ ID NO: 35015 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aatgactatacttaacattg

SEQ ID NO: 35016 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gttttaaatatcaaattatg

SEQ ID NO: 35017 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gtttcacgaaattcacattt

SEQ ID NO: 35018 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gacactgaccaaagaagaac

SEQ ID NO: 35019 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
actaaagacactgaccaaag

SEQ ID NO: 35020 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gagactaaagacactgacca

SEQ ID NO: 35021 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gaaaaaagatcaagagacta

SEQ ID NO: 35022 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttcaatagaaaaaagatcaa

SEQ ID NO: 35023 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atttcaatagaaaaaagatc

SEQ ID NO: 35024 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atgaatatttcaatagaaaa

SEQ ID NO: 35025 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gaaaataatgaatatttcaa

SEQ ID NO: 35026 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cacacaatcccttggcaaac

SEQ ID NO: 35027 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
cacacacacacacaatccct

SEQ ID NO: 35028 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tgaaaaggtatcaatatcct

SEQ ID NO: 35029 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aaaaagaaatttttgtgaaa

SEQ ID NO: 35030 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaaaaagaaatttttgtgaa

SEQ ID NO: 35031 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aactggcaaaagaaaaaaaa

SEQ ID NO: 35032 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaaagatgacaaactggcaa

SEQ ID NO: 35033 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aaagttaaaagatgacaaac

SEQ ID NO: 35034 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tttagtaaagacaaagttaa

SEQ ID NO: 35035 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaccagttttagtaaagaca

SEQ ID NO: 35036 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tttgaaaaccagttttagta

SEQ ID NO: 35037 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tcatttttgaaaaccagttt

SEQ ID NO: 35038 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttctattcatttttgaaaac

SEQ ID NO: 35039 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tactgcataattcctttaaa

SEQ ID NO: 35040 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gttactgcataattccttta

SEQ ID NO: 35041 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ggtaaatatttttaatgtta

SEQ ID NO: 35042 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aaacatatatatgcacaaaa

SEQ ID NO: 35043 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaaacatatatatgcacaaa

SEQ ID NO: 35044 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aataaaactgccctcccaat

SEQ ID NO: 35045 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aaataaaactgccctcccaa

SEQ ID NO: 35046 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atttctaggcctatgtttcc

SEQ ID NO: 35047 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aaaaaaaaaatctcatttct

SEQ ID NO: 35048 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aaaaaaaaaaatctcatttc

SEQ ID NO: 35049 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
atgccactgcactccagact

SEQ ID NO: 35050 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gagatcatgccactgcactc

SEQ ID NO: 35051 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ggcagaggttatagtgagct

SEQ ID NO: 35052 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
caggaggcagaggttatagt

SEQ ID NO: 35053 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aatccaggaggcagaggtta

SEQ ID NO: 35054 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cacttgaatccaggaggcag

SEQ ID NO: 35055 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tcacttgaatccaggaggca

SEQ ID NO: 35056 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aatcacttgaatccaggagg

SEQ ID NO: 35057 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gagaatcacttgaatccagg

SEQ ID NO: 35058 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ggagaatcacttgaatccag

SEQ ID NO: 35059 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
caggagaatcacttgaatcc

SEQ ID NO: 35060 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gcaggagaatcacttgaatc

SEQ ID NO: 35061 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tactcaggaggctgaggcag

SEQ ID NO: 35062 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gctactcaggaggctgaggc

SEQ ID NO: 35063 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
agctactcaggaggctgagg

SEQ ID NO: 35064 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cccagctactcaggaggctg

SEQ ID NO: 35065 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tcccagctactcaggaggct

SEQ ID NO: 35066 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tatagtcccagctactcagg

SEQ ID NO: 35067 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctatagtcccagctactcag

SEQ ID NO: 35068 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
acctatagtcccagctactc

SEQ ID NO: 35069 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cacctatagtcccagctact

SEQ ID NO: 35070 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gtggcaggcacctatagtcc

SEQ ID NO: 35071 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ggcgtggtggcaggcaccta

SEQ ID NO: 35072 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aattagctgggcgtggtggc

SEQ ID NO: 35073 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aaattagctgggcgtggtgg

SEQ ID NO: 35074 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
caaaaattagctgggcgtgg

SEQ ID NO: 35075 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
atacaaaaattagctgggcg

SEQ ID NO: 35076 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
taaaaatacaaaaattagct

SEQ ID NO: 35077 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ctaaaaatacaaaaattagc

SEQ ID NO: 35078 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gctactaaaaatacaaaaat

SEQ ID NO: 35079 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
caagaccatcctggccaaca

SEQ ID NO: 35080 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tcaagagatcaagaccatcc

SEQ ID NO: 35081 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gatcacaaggtcaagagatc

SEQ ID NO: 35082 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cgggcagatcacaaggtcaa

SEQ ID NO: 35083 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ggcgggcagatcacaaggtc

SEQ ID NO: 35084 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gccaaggcgggcagatcaca

SEQ ID NO: 35085 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ggccaaggcgggcagatcac

SEQ ID NO: 35086 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttttgggaggccaaggcggg

SEQ ID NO: 35087 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gcattttgggaggccaaggc

SEQ ID NO: 35088 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
agcattttgggaggccaagg

SEQ ID NO: 35089 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cccagcattttgggaggcca

SEQ ID NO: 35090 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tcccagcattttgggaggcc

SEQ ID NO: 35091 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgtaatcccagcattttggg

SEQ ID NO: 35092 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctgtaatcccagcattttgg

SEQ ID NO: 35093 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gcctgtaatcccagcatttt

SEQ ID NO: 35094 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
cgcctgtaatcccagcattt

SEQ ID NO: 35095 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gtggctcacgcctgtaatcc

SEQ ID NO: 35096 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ctcattttggccaggcgcag

SEQ ID NO: 35097 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aacctcattttggccaggcg

SEQ ID NO: 35098 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgaaaaacctcattttggcc

SEQ ID NO: 35099 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gtgaaaaacctcattttggc

SEQ ID NO: 35100 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ctgtgtgaaaaacctcattt

SEQ ID NO: 35101 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cagcctcagacaagactcca

SEQ ID NO: 35102 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ccagcctcagacaagactcc

SEQ ID NO: 35103 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cccagcctcagacaagactc

SEQ ID NO: 35104 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agcctcacccagcctcagac

SEQ ID NO: 35105 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gaagcagcctcacccagcct

SEQ ID NO: 35106 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ggtaaagaagcagcctcacc

SEQ ID NO: 35107 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttcagtttgaggtaaagaag

SEQ ID NO: 35108 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tagttcagtttgaggtaaag

SEQ ID NO: 35109 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ggatagttcagtttgaggta

SEQ ID NO: 35110 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gagcaggatagttcagtttg

SEQ ID NO: 35111 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tgagcaggatagttcagttt

SEQ ID NO: 35112 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
agaggctgagcaggatagtt

SEQ ID NO: 35113 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gaggcagaggctgagcagga

SEQ ID NO: 35114 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aaaagaggcagaggctgagc

SEQ ID NO: 35115 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gaaaagaggcagaggctgag

SEQ ID NO: 35116 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aaagaaaagaggcagaggct

SEQ ID NO: 35117 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgagaaaagaaaagaggcag

SEQ ID NO: 35118 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctgagaaaagaaaagaggca

SEQ ID NO: 35119 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cactgagaaaagaaaagagg

SEQ ID NO: 35120 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aaacactgagaaaagaaaag

SEQ ID NO: 35121 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
caaacactgagaaaagaaaa

SEQ ID NO: 35122 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cccaaacactgagaaaagaa

SEQ ID NO: 35123 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gatgacccaaacactgagaa

SEQ ID NO: 35124 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aggtggatgacccaaacact

SEQ ID NO: 35125 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gtacagtagctctgaggagg

SEQ ID NO: 35126 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gttgtacagtagctctgagg

SEQ ID NO: 35127 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tgttgtacagtagctctgag

SEQ ID NO: 35128 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aatgttgtacagtagctctg

SEQ ID NO: 35129 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aaatgttgtacagtagctct

SEQ ID NO: 35130 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aataaaaaaatgttgtacag

SEQ ID NO: 35131 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ctaaataaaaaaatgttgta

SEQ ID NO: 35132 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gaatagagtcatctgcatta

SEQ ID NO: 35133 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tataaggtttatttagaata

SEQ ID NO: 35134 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aatataaggtttatttagaa

SEQ ID NO: 35135 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gtattaatataaggtttatt

SEQ ID NO: 35136 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aaatgtagagtattaatata

SEQ ID NO: 35137 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaaatgtagagtattaatat

SEQ ID NO: 35138 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
attatgtgtgtaaaaatgta

SEQ ID NO: 35139 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ccattatgtgtgtaaaaatg

SEQ ID NO: 35140 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tagttcctctaaaatatgtc

SEQ ID NO: 35141 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttaggatgataatcaaataa

SEQ ID NO: 35142 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tactaactgctctgatgctt

SEQ ID NO: 35143 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttactaactgctctgatgct

SEQ ID NO: 35144 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttaaaaatgttctgttcttg

SEQ ID NO: 35145 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
acttaaaaatgttctgttct

SEQ ID NO: 35146 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ggagtcataaacctgcaatt

SEQ ID NO: 35147 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tatttatggggaaaaaatgg

SEQ ID NO: 35148 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gctatttatggggaaaaaat

SEQ ID NO: 35149 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tgctatttatggggaaaaaa

SEQ ID NO: 35150 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
atataagaatgctatttatg

SEQ ID NO: 35151 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aatataagaatgctatttat

SEQ ID NO: 35152 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aaatataagaatgctattta

SEQ ID NO: 35153 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tattcttcaaaaataaatat

SEQ ID NO: 35154 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
atacatacttttgagttttg

SEQ ID NO: 35155 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttttcgttatacatactttt

SEQ ID NO: 35156 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tgggaaacattgaagagtga

SEQ ID NO: 35157 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gctgggaaacattgaagagt

SEQ ID NO: 35158 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gatggctgggaaacattgaa

SEQ ID NO: 35159 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tggatggctgggaaacattg

SEQ ID NO: 35160 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ggggaggaatttggatggct

SEQ ID NO: 35161 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aggggaggaatttggatggc

SEQ ID NO: 35162 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ccacaggggaggaatttgga

SEQ ID NO: 35163 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttgtccacaggggaggaatt

SEQ ID NO: 35164 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
actgtggttgtccacagggg

SEQ ID NO: 35165 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tactgtggttgtccacaggg

SEQ ID NO: 35166 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ggtactgtggttgtccacag

SEQ ID NO: 35167 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tggtactgtggttgtccaca

SEQ ID NO: 35168 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttggtactgtggttgtccac

SEQ ID NO: 35169 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gttggtactgtggttgtcca

SEQ ID NO: 35170 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tacacaaggggttggtactg

SEQ ID NO: 35171 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tggatggatacacaaggggt

SEQ ID NO: 35172 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cacatggatggatacacaag

SEQ ID NO: 35173 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ccacatggatggatacacaa

SEQ ID NO: 35174 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
accacatggatggatacaca

SEQ ID NO: 35175 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaccacatggatggatacac

SEQ ID NO: 35176 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tgctgataaaaccacatgga

SEQ ID NO: 35177 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tacatgctgataaaaccaca

SEQ ID NO: 35178 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tgcatgaaaagaaaaatgaa

SEQ ID NO: 35179 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tagggtattatttgcatgaa

SEQ ID NO: 35180 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tatgaaacaatgtttatata

SEQ ID NO: 35181 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gtatgaaacaatgtttatat

SEQ ID NO: 35182 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ggtatgaaacaatgtttata

SEQ ID NO: 35183 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gatttttaagtgacgaagga

SEQ ID NO: 35184 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgatttttaagtgacgaagg

SEQ ID NO: 35185 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gtctgatttttaagtgacga

SEQ ID NO: 35186 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agtctgatttttaagtgacg

SEQ ID NO: 35187 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gatttccaagtctgattttt

SEQ ID NO: 35188 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gctgatacagaaagatttcc

SEQ ID NO: 35189 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tttatacatgctgatacaga

SEQ ID NO: 35190 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tagctttatacatgctgata

SEQ ID NO: 35191 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gaagctgctataaaaagaag

SEQ ID NO: 35192 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tatgaagctgctataaaaag

SEQ ID NO: 35193 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ctttatgaagctgctataaa

SEQ ID NO: 35194 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ctgtacaataggactttatg

SEQ ID NO: 35195 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tttgggtacagctgtacaat

SEQ ID NO: 35196 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
atttgggtacagctgtacaa

SEQ ID NO: 35197 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atgactaaataatttgggta

SEQ ID NO: 35198 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tgggaatgactaaataattt

SEQ ID NO: 35199 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gtgggaatgactaaataatt

SEQ ID NO: 35200 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
acctaaatgttctacagtgt

SEQ ID NO: 35201 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aacctaaatgttctacagtg

SEQ ID NO: 35202 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gaaacaacctaaatgttcta

SEQ ID NO: 35203 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aagataattattgtagcttt

SEQ ID NO: 35204 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gaagataattattgtagctt

SEQ ID NO: 35205 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
taatgagaagataattattg

SEQ ID NO: 35206 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaaagaaaaaaactaatgag

SEQ ID NO: 35207 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aaaaaaagaaaaaaactaat

SEQ ID NO: 35208 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
acaaaagagtaggttaaaaa

SEQ ID NO: 35209 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aaaagagcccacaaaagagt

SEQ ID NO: 35210 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aaaaagagcccacaaaagag

SEQ ID NO: 35211 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tacaaaaagagcccacaaaa

SEQ ID NO: 35212 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gttacaaaaagagcccacaa

SEQ ID NO: 35213 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
taaaataaaagttacaaaaa

SEQ ID NO: 35214 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cttaaaataaaagttacaaa

SEQ ID NO: 35215 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tacccctgaacttaaaataa

SEQ ID NO: 35216 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agaacaaaaccctgtaacac

SEQ ID NO: 35217 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cttggtgatgaaataagatg

SEQ ID NO: 35218 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
taagaccttggtgatgaaat

SEQ ID NO: 35219 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aagtacttggcttaagacct

SEQ ID NO: 35220 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aactaataagtacttggctt

SEQ ID NO: 35221 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aaaaataactaataagtact

SEQ ID NO: 35222 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gatcaggaaaaataactaat

SEQ ID NO: 35223 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gtggcaggagggaggggatc

SEQ ID NO: 35224 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ggtggcaggagggaggggat

SEQ ID NO: 35225 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tggagggtggcaggagggag

SEQ ID NO: 35226 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gtggagggtggcaggaggga

SEQ ID NO: 35227 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ggtggagggtggcaggaggg

SEQ ID NO: 35228 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gggtggagggtggcaggagg

SEQ ID NO: 35229 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gagggtggagggtggcagga

SEQ ID NO: 35230 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ggagggtggagggtggcagg

SEQ ID NO: 35231 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tggagggtggagggtggcag

SEQ ID NO: 35232 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
attggagggtggagggtggc

SEQ ID NO: 35233 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cattggagggtggagggtgg

SEQ ID NO: 35234 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gcccattggagggtggaggg

SEQ ID NO: 35235 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ggggcccattggagggtgga

SEQ ID NO: 35236 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tggggcccattggagggtgg

SEQ ID NO: 35237 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctggggcccattggagggtg

SEQ ID NO: 35238 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
cactggggcccattggaggg

SEQ ID NO: 35239 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
acacactggggcccattgga

SEQ ID NO: 35240 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cacacactggggcccattgg

SEQ ID NO: 35241 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
acacacactggggcccattg

SEQ ID NO: 35242 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
caacacacactggggcccat

SEQ ID NO: 35243 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ggtgggaacaacacacactg

SEQ ID NO: 35244 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aggtgggaacaacacacact

SEQ ID NO: 35245 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
taggtgggaacaacacacac

SEQ ID NO: 35246 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gaacacatggacacataggt

SEQ ID NO: 35247 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agaacacatggacacatagg

SEQ ID NO: 35248 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
atgagaacacatggacacat

SEQ ID NO: 35249 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gatgagaacacatggacaca

SEQ ID NO: 35250 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agctaaatgatgagaacaca

SEQ ID NO: 35251 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ataagtgagagctaaatgat

SEQ ID NO: 35252 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
atgtcctcacttataagtga

SEQ ID NO: 35253 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gaatgtcctcacttataagt

SEQ ID NO: 35254 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aagagaatgtcctcacttat

SEQ ID NO: 35255 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cgtactgtgaaactattcaa

SEQ ID NO: 35256 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
accgtactgtgaaactattc

SEQ ID NO: 35257 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gactcagcaatttcactctg

SEQ ID NO: 35258 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
acgcacatacaattatgact

SEQ ID NO: 35259 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aattcggcaatattttatta

SEQ ID NO: 35260 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
ctaggtaacaaaagagaatt

SEQ ID NO: 35261 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cgttacactaggtaacaaaa

SEQ ID NO: 35262 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ggcgttacactaggtaacaa

SEQ ID NO: 35263 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ggccctgtaggcgttacact

SEQ ID NO: 35264 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tggccctgtaggcgttacac

SEQ ID NO: 35265 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aaattcagctatggccctgt

SEQ ID NO: 35266 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gaaattcagctatggccctg

SEQ ID NO: 35267 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gtaggatagaaattcagcta

SEQ ID NO: 35268 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gttagggtaggatagaaatt

SEQ ID NO: 35269 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tcagcagagttagggtagga

SEQ ID NO: 35270 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aagatcagcagagttagggt

SEQ ID NO: 35271 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aaagatcagcagagttaggg

SEQ ID NO: 35272 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cttaaagatcagcagagtta

SEQ ID NO: 35273 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tcttaaagatcagcagagtt

SEQ ID NO: 35274 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttcttaaagatcagcagagt

SEQ ID NO: 35275 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctgtttcttaaagatcagca

SEQ ID NO: 35276 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
acctgtttcttaaagatcag

SEQ ID NO: 35277 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tttacctgtttcttaaagat

SEQ ID NO: 35278 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aacattttacctgtttctta

SEQ ID NO: 35279 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tcagctgctctggttacaaa

SEQ ID NO: 35280 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ctaagcaatctcagctgctc

SEQ ID NO: 35281 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atcttggttctaagcaatct

SEQ ID NO: 35282 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tagtcaactatcttggttct

SEQ ID NO: 35283 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agtcctttagtcaactatct

SEQ ID NO: 35284 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gaggtcttcttgaagtcctt

SEQ ID NO: 35285 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgatgcctgaggtcttcttg

SEQ ID NO: 35286 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgagattataatgatgcctg

SEQ ID NO: 35287 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
atgagattataatgatgcct

SEQ ID NO: 35288 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gtgtcatttagcatgaaaat

SEQ ID NO: 35289 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gcactggtgggggtgtcatt

SEQ ID NO: 35290 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aactgtcatggcactggtgg

SEQ ID NO: 35291 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
caactgtcatggcactggtg

SEQ ID NO: 35292 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tcaactgtcatggcactggt

SEQ ID NO: 35293 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
atcaactgtcatggcactgg

SEQ ID NO: 35294 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
attatcaactgtcatggcac

SEQ ID NO: 35295 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
atggggattatcaactgtca

SEQ ID NO: 35296 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ttcttctggtcattgtcatg

SEQ ID NO: 35297 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cttcttctggtcattgtcat

SEQ ID NO: 35298 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gcttcttctggtcattgtca

SEQ ID NO: 35299 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tgtccttttatggcttcttc

SEQ ID NO: 35300 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ccttcctttttgtcctttta

SEQ ID NO: 35301 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tggtgaacttcttggaacca

SEQ ID NO: 35302 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ggtggtgaacttcttggaac

SEQ ID NO: 35303 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gaaataggtggtgaacttct

SEQ ID NO: 35304 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
atgtcttttccagaaatagg

SEQ ID NO: 35305 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttcatgtcttttccagaaat

SEQ ID NO: 35306 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gttcatgtcttttccagaaa

SEQ ID NO: 35307 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aggaatgttcatgtcttttc

SEQ ID NO: 35308 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tggtcattaagagtgagggg

SEQ ID NO: 35309 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttggtcattaagagtgaggg

SEQ ID NO: 35310 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
agttggtcattaagagtgag

SEQ ID NO: 35311 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aagttggtcattaagagtga

SEQ ID NO: 35312 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gaagttggtcattaagagtg

SEQ ID NO: 35313 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
agaagttggtcattaagagt

SEQ ID NO: 35314 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
atgaagaagttggtcattaa

SEQ ID NO: 35315 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
taatgaagaagttggtcatt

SEQ ID NO: 35316 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agtatatctaatgaagaagt

SEQ ID NO: 35317 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agaaagtatatctaatgaag

SEQ ID NO: 35318 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aatagaaagtatatctaatg

SEQ ID NO: 35319 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agtgaggaaattgaaataga

SEQ ID NO: 35320 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gaggagtgaggaaattgaaa

SEQ ID NO: 35321 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttcttgactagtgaggagtg

SEQ ID NO: 35322 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cttcttgactagtgaggagt

SEQ ID NO: 35323 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctaacttcttgactagtgag

SEQ ID NO: 35324 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
agctaacttcttgactagtg

SEQ ID NO: 35325 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aagctaacttcttgactagt

SEQ ID NO: 35326 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gcacaagctaacttcttgac

SEQ ID NO: 35327 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gaagtgcaagtatggcgcac

SEQ ID NO: 35328 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agaatggagaagtgcaagta

SEQ ID NO: 35329 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gccaaagaatggagaagtgc

SEQ ID NO: 35330 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tcgatggccaaagaatggag

SEQ ID NO: 35331 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tattcgatggccaaagaatg

SEQ ID NO: 35332 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tttattcgatggccaaagaa

SEQ ID NO: 35333 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
caagctttattcgatggcca

SEQ ID NO: 35334 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gcaatgcaagctttattcga

SEQ ID NO: 35335 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aagtgagcatcaagcaatgc

SEQ ID NO: 35336 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gaaatgggaaagtgagcatc

SEQ ID NO: 35337 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aatacaagaaatgggaaagt

SEQ ID NO: 35338 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
acccaatacaagaaatggga

SEQ ID NO: 35339 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ggagacccaatacaagaaat

SEQ ID NO: 35340 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tggagacccaatacaagaaa

SEQ ID NO: 35341 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tggtattggagacccaatac

SEQ ID NO: 35342 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tctttccctgtttggtattg

SEQ ID NO: 35343 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
catctttccctgtttggtat

SEQ ID NO: 35344 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aggtggcatctttccctgtt

SEQ ID NO: 35345 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tccttggtagtttcaaaagg

SEQ ID NO: 35346 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
acctccttggtagtttcaaa

SEQ ID NO: 35347 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aacctccttggtagtttcaa

SEQ ID NO: 35348 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tataccaataacctccttgg

SEQ ID NO: 35349 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
caatataccaataacctcct

SEQ ID NO: 35350 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
attgataggcctttatgaag

SEQ ID NO: 35351 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ggattgataggcctttatga

SEQ ID NO: 35352 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tggattgataggcctttatg

SEQ ID NO: 35353 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tggggagagcatggattgat

SEQ ID NO: 35354 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttggggagagcatggattga

SEQ ID NO: 35355 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
cacattgtttggggagagca

SEQ ID NO: 35356 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cctgacacattgtttgggga

SEQ ID NO: 35357 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tccctgacacattgtttggg

SEQ ID NO: 35358 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aatccctgacacattgtttg

SEQ ID NO: 35359 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
caatccctgacacattgttt

SEQ ID NO: 35360 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
acaatccctgacacattgtt

SEQ ID NO: 35361 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tttatgaaatactttattga

SEQ ID NO: 35362 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atttatgaaatactttattg

SEQ ID NO: 35363 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ccccacttattaggctcaca

SEQ ID NO: 35364 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
agttttattccccacttatt

SEQ ID NO: 35365 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aagttttattccccacttat

SEQ ID NO: 35366 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ataaataaataaataaataa

SEQ ID NO: 35367 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctccagcctgggcaatgaga

SEQ ID NO: 35368 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cactccagcctgggcaatga

SEQ ID NO: 35369 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ggcactccagcctgggcaat

SEQ ID NO: 35370 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gcaccaaggcactccagcct

SEQ ID NO: 35371 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
cgcaccaaggcactccagcc

SEQ ID NO: 35372 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gagatcgcaccaaggcactc

SEQ ID NO: 35373 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
agtgagctgagatcgcacca

SEQ ID NO: 35374 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cagtgagctgagatcgcacc

SEQ ID NO: 35375 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ggcagatgttgcagtgagct

SEQ ID NO: 35376 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
caggaggcagatgttgcagt

SEQ ID NO: 35377 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aacccaggaggcagatgttg

SEQ ID NO: 35378 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aactgcttgaacccaggagg

SEQ ID NO: 35379 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gagaactgcttgaacccagg

SEQ ID NO: 35380 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ggagaactgcttgaacccag

SEQ ID NO: 35381 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
caggagaactgcttgaaccc

SEQ ID NO: 35382 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gcaggagaactgcttgaacc

SEQ ID NO: 35383 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tactcaggaggctgaggcag

SEQ ID NO: 35384 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gctactcaggaggctgaggc

SEQ ID NO: 35385 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
agctactcaggaggctgagg

SEQ ID NO: 35386 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ccgagctactcaggaggctg

SEQ ID NO: 35387 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tccgagctactcaggaggct

SEQ ID NO: 35388 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tctaatccgagctactcagg

SEQ ID NO: 35389 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctctaatccgagctactcag

SEQ ID NO: 35390 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
acctctaatccgagctactc

SEQ ID NO: 35391 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tacctctaatccgagctact

SEQ ID NO: 35392 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gtggtgggtacctctaatcc

SEQ ID NO: 35393 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aattagccgggtgtggtggt

SEQ ID NO: 35394 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aaattagccgggtgtggtgg

SEQ ID NO: 35395 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
caaaaattagccgggtgtgg

SEQ ID NO: 35396 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gtacaaaaattagccgggtg

SEQ ID NO: 35397 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
taaaggtacaaaaattagcc

SEQ ID NO: 35398 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
ctaaaggtacaaaaattagc

SEQ ID NO: 35399 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tctactaaaggtacaaaaat

SEQ ID NO: 35400 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgaaaacctgtctctactaa

SEQ ID NO: 35401 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gtgaaaacctgtctctacta

SEQ ID NO: 35402 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ggagaccagcctggccaaca

SEQ ID NO: 35403 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tcaggagttggagaccagcc

SEQ ID NO: 35404 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tgaggtcaggagttggagac

SEQ ID NO: 35405 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tcacatgaggtcaggagttg

SEQ ID NO: 35406 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gatcacatgaggtcaggagt

SEQ ID NO: 35407 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ggtggatcacatgaggtcag

SEQ ID NO: 35408 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgggtggatcacatgaggtc

SEQ ID NO: 35409 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atgggtggatcacatgaggt

SEQ ID NO: 35410 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgagatgggtggatcacatg

SEQ ID NO: 35411 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctgagatgggtggatcacat

SEQ ID NO: 35412 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ctttgggaagctgagatggg

SEQ ID NO: 35413 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gcactttgggaagctgagat

SEQ ID NO: 35414 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agcactttgggaagctgaga

SEQ ID NO: 35415 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tcccagcactttgggaagct

SEQ ID NO: 35416 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgtgatcccagcactttggg

SEQ ID NO: 35417 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gtttgtgatcccagcacttt

SEQ ID NO: 35418 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tgtttgtgatcccagcactt

SEQ ID NO: 35419 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gtggctcatgtttgtgatcc

SEQ ID NO: 35420 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aagttttcggccgggtgtgg

SEQ ID NO: 35421 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aagaagttttcggccgggtg

SEQ ID NO: 35422 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gaattaagaagttttcggcc

SEQ ID NO: 35423 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
agaattaagaagttttcggc

SEQ ID NO: 35424 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
gataagaattaagaagtttt

SEQ ID NO: 35425 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ctaaaatgataagaattaag

SEQ ID NO: 35426 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaactaaaatgataagaatt

SEQ ID NO: 35427 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaaatgcaaactaaaatgat

SEQ ID NO: 35428 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atccctgacctcactcacaa

SEQ ID NO: 35429 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atggcatctgaggatatgaa

SEQ ID NO: 35430 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aaaagcacaaatggcatctg

SEQ ID NO: 35431 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aaaaagcacaaatggcatct

SEQ ID NO: 35432 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
cacagaaaaaaaagcacaaa

SEQ ID NO: 35433 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cagacagagcacagaaaaaa

SEQ ID NO: 35434 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gactacatacagacagagca

SEQ ID NO: 35435 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gacaagactacatacagaca

SEQ ID NO: 35436 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tggacaagactacatacaga

SEQ ID NO: 35437 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aaagtggacaagactacata

SEQ ID NO: 35438 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agtctattaaaaaagtggac

SEQ ID NO: 35439 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ctgatagtctattaaaaaag

SEQ ID NO: 35440 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
acactgatagtctattaaaa

SEQ ID NO: 35441 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ctaaattaataaaacactga

SEQ ID NO: 35442 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
taattttattattttgttaa

SEQ ID NO: 35443 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gctaattttattattttgtt

SEQ ID NO: 35444 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tattgtataccacagaaaaa

SEQ ID NO: 35445 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aatatttgtattgtatacca

SEQ ID NO: 35446 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
taaaccaaaagaaacaaaaa

SEQ ID NO: 35447 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gataaactaccataaaccaa

SEQ ID NO: 35448 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
taaaatgtagatgcttttaa

SEQ ID NO: 35449 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aattcaatttaattaaaatg

SEQ ID NO: 35450 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ggagccactggagaaaggat

SEQ ID NO: 35451 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
acacaggagccactggagaa

SEQ ID NO: 35452 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aacacaggagccactggaga

SEQ ID NO: 35453 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ataaaacacaggagccactg

SEQ ID NO: 35454 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
atataaaacacaggagccac

SEQ ID NO: 35455 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
taagataatataaaacacag

SEQ ID NO: 35456 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tctaagataatataaaacac

SEQ ID NO: 35457 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttctaagataatataaaaca

SEQ ID NO: 35458 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgaagtagaaattattttct

SEQ ID NO: 35459 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cacttatgaagtacttgaag

SEQ ID NO: 35460 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tcacacttatgaagtacttg

SEQ ID NO: 35461 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
acccagtcatcacacttatg

SEQ ID NO: 35462 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cacatatgcatgtgaaaacc

SEQ ID NO: 35463 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gtcattacaaggtttgaggg

SEQ ID NO: 35464 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tgtcattacaaggtttgagg

SEQ ID NO: 35465 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aatgtcattacaaggtttga

SEQ ID NO: 35466 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
caatgtcattacaaggtttg

SEQ ID NO: 35467 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tcaatgtcattacaaggttt

SEQ ID NO: 35468 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aatatatcaatgtcattaca

SEQ ID NO: 35469 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
taatatatcaatgtcattac

SEQ ID NO: 35470 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttttttcttttcacctgaga

SEQ ID NO: 35471 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tttcttttttcttttcacct

SEQ ID NO: 35472 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgctagaagaaaacatgtga

SEQ ID NO: 35473 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ctgctagaagaaaacatgtg

SEQ ID NO: 35474 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
acaaaccacaaaactgctag

SEQ ID NO: 35475 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
catacaaaccacaaaactgc

SEQ ID NO: 35476 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
taacccaagatacattttag

SEQ ID NO: 35477 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
acctaacccaagatacattt

SEQ ID NO: 35478 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
actgctttgccacctaaccc

SEQ ID NO: 35479 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
catgtggataaaaataaatt

SEQ ID NO: 35480 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gggacacctgggtagtcatg

SEQ ID NO: 35481 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttatcattgggacacctggg

SEQ ID NO: 35482 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tagttatcattgggacacct

SEQ ID NO: 35483 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
atagttatcattgggacacc

SEQ ID NO: 35484 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
attatttaatagttatcatt

SEQ ID NO: 35485 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tattatttaatagttatcat

SEQ ID NO: 35486 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttgaaagaaatattatttaa

SEQ ID NO: 35487 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tagcatcttaaataggttga

SEQ ID NO: 35488 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ataaaggtagcatcttaaat

SEQ ID NO: 35489 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tataaaggtagcatcttaaa

SEQ ID NO: 35490 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
acatatgagaattataaagg

SEQ ID NO: 35491 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gttacatatgagaattataa

SEQ ID NO: 35492 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agttacatatgagaattata

SEQ ID NO: 35493 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aaatagacatagttacatat

SEQ ID NO: 35494 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
acgatatccagaaatagaca

SEQ ID NO: 35495 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gaaaatacgatatccagaaa

SEQ ID NO: 35496 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttggaagaaaatacgatatc

SEQ ID NO: 35497 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ctacatagatagttcattgg

SEQ ID NO: 35498 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gacctacatagatagttcat

SEQ ID NO: 35499 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
agtatggtgacctacataga

SEQ ID NO: 35500 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aaatagtatggtgacctaca

SEQ ID NO: 35501 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
atagggtaattaaaatagta

SEQ ID NO: 35502 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tgcaaatagggtaattaaaa

SEQ ID NO: 35503 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aatgttattttatgcaaata

SEQ ID NO: 35504 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
taatgttattttatgcaaat

SEQ ID NO: 35505 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ataatgttattttatgcaaa

SEQ ID NO: 35506 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cataaaagagtaatatctaa

SEQ ID NO: 35507 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gaaattgtacacacataaaa

SEQ ID NO: 35508 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gggaaattgtacacacataa

SEQ ID NO: 35509 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tagataatctggatctagtt

SEQ ID NO: 35510 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttagataatctggatctagt

SEQ ID NO: 35511 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ggaattagataatctggatc

SEQ ID NO: 35512 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ccatttggaattagataatc

SEQ ID NO: 35513 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gaaattttcccatttggaat

SEQ ID NO: 35514 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aaaatagaaattttcccatt

SEQ ID NO: 35515 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aatcccaatgaaaataaaaa

SEQ ID NO: 35516 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttttaaccttttaatttata

SEQ ID NO: 35517 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gtcagagtgcttaccattgg

SEQ ID NO: 35518 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agagtcagagtgcttaccat

SEQ ID NO: 35519 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aggtattaaaaaaagagtca

SEQ ID NO: 35520 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
agaggtattaaaaaaagagt

SEQ ID NO: 35521 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aagaagaggtattaaaaaaa

SEQ ID NO: 35522 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
taaagaagaggtattaaaaa

SEQ ID NO: 35523 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gtttttataatctaaagaag

SEQ ID NO: 35524 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tgtttttataatctaaagaa

SEQ ID NO: 35525 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tttgtttttataatctaaag

SEQ ID NO: 35526 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tactttgtttttataatcta

SEQ ID NO: 35527 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttttcttgtgatattatact

SEQ ID NO: 35528 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gaggttctaaaatgagtagc

SEQ ID NO: 35529 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
attagaggttctaaaatgag

SEQ ID NO: 35530 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aacattagaggttctaaaat

SEQ ID NO: 35531 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
attgatacacttaacattag

SEQ ID NO: 35532 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tattgatacacttaacatta

SEQ ID NO: 35533 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tatattgatacacttaacat

SEQ ID NO: 35534 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agtatttaatgaaaagtatt

SEQ ID NO: 35535 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tcaggcaagtatttaatgaa

SEQ ID NO: 35536 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
taagatttcagcaatcaggc

SEQ ID NO: 35537 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
atggtaagatttcagcaatc

SEQ ID NO: 35538 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aatggtaagatttcagcaat

SEQ ID NO: 35539 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aggatgcaatggtaagattt

SEQ ID NO: 35540 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cttatgaaggatgcaatggt

SEQ ID NO: 35541 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gttacttatgaaggatgcaa

SEQ ID NO: 35542 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
taacataatgttacttatga

SEQ ID NO: 35543 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttaacataatgttacttatg

SEQ ID NO: 35544 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
taagaaataataattatttt

SEQ ID NO: 35545 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ctaccaaattaagcatttct

SEQ ID NO: 35546 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gatttgccatctaccaaatt

SEQ ID NO: 35547 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atattgaactactcttgttg

SEQ ID NO: 35548 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ccataaaattgaatgatttt

SEQ ID NO: 35549 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gccataaaattgaatgattt

SEQ ID NO: 35550 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gcttaatttgttttgcatac

SEQ ID NO: 35551 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atataaaattatcgcatata

SEQ ID NO: 35552 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aatttagaaatagtccctat

SEQ ID NO: 35553 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ataatcatagaatttagaaa

SEQ ID NO: 35554 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
attttaataatcatagaatt

SEQ ID NO: 35555 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tcacaatattttaataatca

SEQ ID NO: 35556 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
taatataaatgattattaca

SEQ ID NO: 35557 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ataatataaatgattattac

SEQ ID NO: 35558 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tataatataaatgattatta

SEQ ID NO: 35559 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tattttaaaaggctatacat

SEQ ID NO: 35560 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gaggaatactatattttaaa

SEQ ID NO: 35561 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgaggaatactatattttaa

SEQ ID NO: 35562 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tttcatttcttataaacttg

SEQ ID NO: 35563 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctttcatttcttataaactt

SEQ ID NO: 35564 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
taggcgtgagccaccacgcc

SEQ ID NO: 35565 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
agtgctgggattataggcgt

SEQ ID NO: 35566 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tcccaaagtgctgggattat

SEQ ID NO: 35567 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttcccaaagtgctgggatta

SEQ ID NO: 35568 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cctcggcttcccaaagtgct

SEQ ID NO: 35569 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gcctcggcttcccaaagtgc

SEQ ID NO: 35570 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ccgcctgcctcggcttccca

SEQ ID NO: 35571 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
ctcaggtgatccgcctgcct

SEQ ID NO: 35572 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ggtcttgaattcctgacctc

SEQ ID NO: 35573 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tggtcttgaattcctgacct

SEQ ID NO: 35574 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tttctccatgttggtcaggc

SEQ ID NO: 35575 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ggggtttctccatgttggtc

SEQ ID NO: 35576 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cggggtttctccatgttggt

SEQ ID NO: 35577 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gagacggggtttctccatgt

SEQ ID NO: 35578 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ttgtatttttagtagagacg

SEQ ID NO: 35579 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tttgtatttttagtagagac

SEQ ID NO: 35580 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
ttttgtatttttagtagaga

SEQ ID NO: 35581 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctaattttgtatttttagta

SEQ ID NO: 35582 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
agctaattttgtatttttag

SEQ ID NO: 35583 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
accagctaattttgtatttt

SEQ ID NO: 35584 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
caggcatgcgccaccatgac

SEQ ID NO: 35585 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tcctgagtagctgggattac

SEQ ID NO: 35586 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ctcctgagtagctgggatta

SEQ ID NO: 35587 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cctcagcctcctgagtagct

SEQ ID NO: 35588 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gcctcagcctcctgagtagc

SEQ ID NO: 35589 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tcctgcctcagcctcctgag

SEQ ID NO: 35590 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttctcctgcctcagcctcct

SEQ ID NO: 35591 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttcaagcagttctcctgcct

SEQ ID NO: 35592 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atccacctcccgggttcaag

SEQ ID NO: 35593 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
acaatccacctcccgggttc

SEQ ID NO: 35594 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ctcactacaatccacctccc

SEQ ID NO: 35595 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
gctcactacaatccacctcc

SEQ ID NO: 35596 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ggagtgcaatggcccgatct

SEQ ID NO: 35597 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttgcccaggctggagtgcaa

SEQ ID NO: 35598 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cgctcttgttgcccaggctg

SEQ ID NO: 35599 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttcgctcttgttgcccaggc

SEQ ID NO: 35600 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gagtttcgctcttgttgccc

SEQ ID NO: 35601 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
agagtttcgctcttgttgcc

SEQ ID NO: 35602 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttttttttttttttgagaca

SEQ ID NO: 35603 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttttttttttttttttgaga

SEQ ID NO: 35604 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tttctttttttttttttttt

SEQ ID NO: 35605 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cccagggtaatacacttctt

SEQ ID NO: 35606 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
actaatcttaagttttccca

SEQ ID NO: 35607 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cactaatcttaagttttccc

SEQ ID NO: 35608 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
acactaatcttaagttttcc

SEQ ID NO: 35609 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
caaatgttgacactaatctt

SEQ ID NO: 35610 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
attaaaacgttcagatatgc

SEQ ID NO: 35611 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gaattttttattaaaacgtt

SEQ ID NO: 35612 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tttatacatgctgtacagat

SEQ ID NO: 35613 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cttcctttatacatgctgta

SEQ ID NO: 35614 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gggatttaacgtgaactaag

SEQ ID NO: 35615 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gatgggatttaacgtgaact

SEQ ID NO: 35616 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gtcttaactaacagagagat

SEQ ID NO: 35617 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agtcttaactaacagagaga

SEQ ID NO: 35618 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ataaagtcttaactaacaga

SEQ ID NO: 35619 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
caataaagtcttaactaaca

SEQ ID NO: 35620 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ctcaataaagtcttaactaa

SEQ ID NO: 35621 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ataattttgtgctctcaata

SEQ ID NO: 35622 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agaacctgttctgcagccat

SEQ ID NO: 35623 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
agggtatagaacctgttctg

SEQ ID NO: 35624 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
taattatttaaataagggta

SEQ ID NO: 35625 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ctctctaattatttaaataa

SEQ ID NO: 35626 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tctctctaattatttaaata

SEQ ID NO: 35627 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttctctctaattatttaaat

SEQ ID NO: 35628 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ggatacatgtataataatat

SEQ ID NO: 35629 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tgttgatgttttgagggaag

SEQ ID NO: 35630 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tcatgttgatgttttgaggg

SEQ ID NO: 35631 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aaatcatgttgatgttttga

SEQ ID NO: 35632 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
taaatcatgttgatgttttg

SEQ ID NO: 35633 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctaaatcatgttgatgtttt

SEQ ID NO: 35634 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cctaagtctgcctggtgcca

SEQ ID NO: 35635 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aattcaaacctaagtctgcc

SEQ ID NO: 35636 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
taaacaggaaattcaaacct

SEQ ID NO: 35637 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gctaattatatggaataaac

SEQ ID NO: 35638 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
agctaattatatggaataaa

SEQ ID NO: 35639 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
atgctgcagagctaattata

SEQ ID NO: 35640 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ggaatttgcataatgctgca

SEQ ID NO: 35641 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ggggaatttgcataatgctg

SEQ ID NO: 35642 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
atttctctctttcatttatg

SEQ ID NO: 35643 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tatttctctctttcatttat

SEQ ID NO: 35644 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
atatttctctctttcattta

SEQ ID NO: 35645 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tacatgataactttataaga

SEQ ID NO: 35646 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
attctacatgataactttat

SEQ ID NO: 35647 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tttagcctaggcactgtggt

SEQ ID NO: 35648 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
atttagcctaggcactgtgg

SEQ ID NO: 35649 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tttatttagcctaggcactg

SEQ ID NO: 35650 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgctgttatttatttagcct

SEQ ID NO: 35651 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttgctgttatttatttagcc

SEQ ID NO: 35652 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
taatcttgctgttatttatt

SEQ ID NO: 35653 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttcagtctgtatagggaaga

SEQ ID NO: 35654 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tttcagtctgtatagggaag

SEQ ID NO: 35655 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaatttcagtctgtataggg

SEQ ID NO: 35656 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
taaaaatttcagtctgtata

SEQ ID NO: 35657 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttaaaaatttcagtctgtat

SEQ ID NO: 35658 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tttaaaaatttcagtctgta

SEQ ID NO: 35659 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ggcttattatttaaaaattt

SEQ ID NO: 35660 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tgtgtttattggccaactca

SEQ ID NO: 35661 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tcgtaaggttttgtgtttat

SEQ ID NO: 35662 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ctccacataagattttcgta

SEQ ID NO: 35663 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
actccacataagattttcgt

SEQ ID NO: 35664 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gtaacaaatatactccacat

SEQ ID NO: 35665 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgtttggcaagataaaacat

SEQ ID NO: 35666 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
atgtttggcaagataaaaca

SEQ ID NO: 35667 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aagccataaacatgtttggc

SEQ ID NO: 35668 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
attaaagccataaacatgtt

SEQ ID NO: 35669 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cagatctatattttaaatta

SEQ ID NO: 35670 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gctgtcttactattttactg

SEQ ID NO: 35671 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gagccatgaatttaacaact

SEQ ID NO: 35672 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ggagccatgaatttaacaac

SEQ ID NO: 35673 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cccatgcctctctcactctg

SEQ ID NO: 35674 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aacccatgcctctctcactc

SEQ ID NO: 35675 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
agctagtaagcagtagagat

SEQ ID NO: 35676 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aagctagtaagcagtagaga

SEQ ID NO: 35677 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
acataagctagtaagcagta

SEQ ID NO: 35678 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ggacataagctagtaagcag

SEQ ID NO: 35679 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
caaggacataagctagtaag

SEQ ID NO: 35680 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ccccaaggacataagctagt

SEQ ID NO: 35681 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aattccccaaggacataagc

SEQ ID NO: 35682 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
attaaattccccaaggacat

SEQ ID NO: 35683 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gaagttaattaaattcccca

SEQ ID NO: 35684 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agaagttaattaaattcccc

SEQ ID NO: 35685 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ataagaactgagctttagag

SEQ ID NO: 35686 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tatataagaactgagcttta

SEQ ID NO: 35687 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gctatataagaactgagctt

SEQ ID NO: 35688 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cggtttgctatataagaact

SEQ ID NO: 35689 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tcagctccggtttgctatat

SEQ ID NO: 35690 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
aggattatcattttcagctc

SEQ ID NO: 35691 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ccttaaaggattatcatttt

SEQ ID NO: 35692 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttccactaaaataaccttaa

SEQ ID NO: 35693 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tttccactaaaataacctta

SEQ ID NO: 35694 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tgtgctaagttattaaaatt

SEQ ID NO: 35695 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agtgtaacaggaaatgtgct

SEQ ID NO: 35696 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttgtgcactgaaagtgtaac

SEQ ID NO: 35697 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
attgtgcactgaaagtgtaa

SEQ ID NO: 35698 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tacaatgtattgtgcactga

SEQ ID NO: 35699 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gctaaaatcactaataataa

SEQ ID NO: 35700 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tacaaaatcaacttagaaga

SEQ ID NO: 35701 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ggtatacaaaatcaacttag

SEQ ID NO: 35702 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttaggtatacaaaatcaact

SEQ ID NO: 35703 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttcctaagaacattagcttt

SEQ ID NO: 35704 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gttcctaagaacattagctt

SEQ ID NO: 35705 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
attctcgttcctaagaacat

SEQ ID NO: 35706 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gcaaatatattctcgttcct

SEQ ID NO: 35707 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aagcttttctattataaagt

SEQ ID NO: 35708 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
acaaaagcttttctattata

SEQ ID NO: 35709 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gttttgtatatgcaatacaa

SEQ ID NO: 35710 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gaaagctccctaagaagaaa

SEQ ID NO: 35711 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgaaagctccctaagaagaa

SEQ ID NO: 35712 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgagttgaaagctccctaag

SEQ ID NO: 35713 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttctgagttgaaagctccct

SEQ ID NO: 35714 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tttaaaatattctgagttga

SEQ ID NO: 35715 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tttagtctttaaaatattct

SEQ ID NO: 35716 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tttgctataagcatacattt

SEQ ID NO: 35717 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgtagtcttggttttgctat

SEQ ID NO: 35718 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ggtagaaggcaatgtagtct

SEQ ID NO: 35719 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cctgttggtagaaggcaatg

SEQ ID NO: 35720 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tattgccacctgttggtaga

SEQ ID NO: 35721 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atattgccacctgttggtag

SEQ ID NO: 35722 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
catatattgccacctgttgg

SEQ ID NO: 35723 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tggcatatattgccacctgt

SEQ ID NO: 35724 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aggactaaaatggctgtgtg

SEQ ID NO: 35725 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttgtattggcaggactaaaa

SEQ ID NO: 35726 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ctaatgaactttgtattggc

SEQ ID NO: 35727 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
actaatgaactttgtattgg

SEQ ID NO: 35728 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
taaactaatgaactttgtat

SEQ ID NO: 35729 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aaagcaaggcccacatcctg

SEQ ID NO: 35730 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tttatataaccttgaaagca

SEQ ID NO: 35731 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atttatataaccttgaaagc

SEQ ID NO: 35732 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aagaatttatataaccttga

SEQ ID NO: 35733 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttatcaaacctgatggattt

SEQ ID NO: 35734 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tccacatttatcaaacctga

SEQ ID NO: 35735 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttcaacatcctcggtgtgtt

SEQ ID NO: 35736 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
attaaatctttcaacatcct

SEQ ID NO: 35737 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
atcattttattatttttctt

SEQ ID NO: 35738 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
taattctgctcagtcctaga

SEQ ID NO: 35739 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ataattctgctcagtcctag

SEQ ID NO: 35740 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cataattctgctcagtccta

SEQ ID NO: 35741 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tgcataattctgctcagtcc

SEQ ID NO: 35742 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aacttttgcataattctgct

SEQ ID NO: 35743 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tatcttgctggctattgcct

SEQ ID NO: 35744 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
caatgttccttgtatcttgc

SEQ ID NO: 35745 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aaatcctctgactcatgcta

SEQ ID NO: 35746 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aaaaatcctctgactcatgc

SEQ ID NO: 35747 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cactttagcattaagttctg

SEQ ID NO: 35748 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ctcactttagcattaagttc

SEQ ID NO: 35749 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tcttttctcactttagcatt

SEQ ID NO: 35750 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tacctagtcttttctcactt

SEQ ID NO: 35751 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tgccttcttgaatgaatacc

SEQ ID NO: 35752 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tcagcagctgttactgtgct

SEQ ID NO: 35753 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
catcaggaatatttcatcag

SEQ ID NO: 35754 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ccccatcaggaatatttcat

SEQ ID NO: 35755 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttaacaattcctgccccatc

SEQ ID NO: 35756 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tttaacaattcctgccccat

SEQ ID NO: 35757 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tattttgatattgaattaaa

SEQ ID NO: 35758 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttattttgatattgaattaa

SEQ ID NO: 35759 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cttattttgatattgaatta

SEQ ID NO: 35760 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aaatgttccaaagaatactt

SEQ ID NO: 35761 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
caatgtccacaaatgttcca

SEQ ID NO: 35762 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
atcttatgagtagatgtcac

SEQ ID NO: 35763 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttcatcaaaaatcttatgag

SEQ ID NO: 35764 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gtcttcatcaaaaatcttat

SEQ ID NO: 35765 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
acccccttcctttgctaata

SEQ ID NO: 35766 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttcctttagactcctcaaac

SEQ ID NO: 35767 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cactaaataaactgttcctt

SEQ ID NO: 35768 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ccatagtactttaccatctc

SEQ ID NO: 35769 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aactcatgttatttatacca

SEQ ID NO: 35770 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttagtttgcaaaaggtttgt

SEQ ID NO: 35771 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgaacatgttagtttgcaaa

SEQ ID NO: 35772 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atgaacatgttagtttgcaa

SEQ ID NO: 35773 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
agtcatatctatgaacatgt

SEQ ID NO: 35774 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agagaaataagaaacacagg

SEQ ID NO: 35775 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
agcagagaaataagaaacac

SEQ ID NO: 35776 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gagcagagaaataagaaaca

SEQ ID NO: 35777 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ccaagagagagcagagaaat

SEQ ID NO: 35778 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tttagttccaagagagagca

SEQ ID NO: 35779 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cctttagttccaagagagag

SEQ ID NO: 35780 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cagcctttagttccaagaga

SEQ ID NO: 35781 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cacagcctttagttccaaga

SEQ ID NO: 35782 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
atcacagcctttagttccaa

SEQ ID NO: 35783 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
taatcacagcctttagttcc

SEQ ID NO: 35784 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cttgccataatcacagcctt

SEQ ID NO: 35785 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tagataccttgccataatca

SEQ ID NO: 35786 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cagattatggtgagggttcc

SEQ ID NO: 35787 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
atattcccagattatggtga

SEQ ID NO: 35788 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
catattcccagattatggtg

SEQ ID NO: 35789 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tcatattcccagattatggt

SEQ ID NO: 35790 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttcatcatattcccagatta

SEQ ID NO: 35791 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
catgagtttcatcatattcc

SEQ ID NO: 35792 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cattttaaacaatatcacat

SEQ ID NO: 35793 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tttaacaacaacaacagaaa

SEQ ID NO: 35794 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tttttaacaacaacaacaga

SEQ ID NO: 35795 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tatatttttaacaacaacaa

SEQ ID NO: 35796 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttaattcacccttaaaaaaa

SEQ ID NO: 35797 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gccccaaaatggcagaaagt

SEQ ID NO: 35798 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttctgccccaaaatggcaga

SEQ ID NO: 35799 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aaaattctgccccaaaatgg

SEQ ID NO: 35800 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ctgaaaattctgccccaaaa

SEQ ID NO: 35801 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
caatcctatttatatctgtg

SEQ ID NO: 35802 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ccaatcctatttatatctgt

SEQ ID NO: 35803 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
cctgtgattgttatctaatt

SEQ ID NO: 35804 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
atataaatttgaggaaggat

SEQ ID NO: 35805 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aatataaatttgaggaagga

SEQ ID NO: 35806 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ctggaatataaatttgagga

SEQ ID NO: 35807 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tctggaatataaatttgagg

SEQ ID NO: 35808 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ccttctggaatataaatttg

SEQ ID NO: 35809 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tccttctggaatataaattt

SEQ ID NO: 35810 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttaggcaaaacacttccttc

SEQ ID NO: 35811 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ctgagataaagcaaatgttt

SEQ ID NO: 35812 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tctgagataaagcaaatgtt

SEQ ID NO: 35813 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gagtcttggattctgagata

SEQ ID NO: 35814 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gatcaggagtcttggattct

SEQ ID NO: 35815 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ataaatttgatcaggagtct

SEQ ID NO: 35816 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tggaatataaatttgatcag

SEQ ID NO: 35817 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tctggaatataaatttgatc

SEQ ID NO: 35818 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttctggaatataaatttgat

SEQ ID NO: 35819 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttaataattttaattccttc

SEQ ID NO: 35820 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gaatccaagcctcctggtca

SEQ ID NO: 35821 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
atctcagaatccaagcctcc

SEQ ID NO: 35822 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cttgctttatctcagaatcc

SEQ ID NO: 35823 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cctatgcacttgctttatct

SEQ ID NO: 35824 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gaagtctgtaaataaaagtt

SEQ ID NO: 35825 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaaaagaagtctgtaaataa

SEQ ID NO: 35826 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tcagttagaataataaaaag

SEQ ID NO: 35827 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tcatcagttagaataataaa

SEQ ID NO: 35828 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gaacaggtcaattcatcagt

SEQ ID NO: 35829 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aaatgaacaggtcaattcat

SEQ ID NO: 35830 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ggacatttaaaaaaatgaac

SEQ ID NO: 35831 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tggacatttaaaaaaatgaa

SEQ ID NO: 35832 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tttcatgaaaatatgacata

SEQ ID NO: 35833 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tatggaaactccaggtcact

SEQ ID NO: 35834 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgactatttatggaaactcc

SEQ ID NO: 35835 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gtgactatttatggaaactc

SEQ ID NO: 35836 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tgaaaaatggtgactattta

SEQ ID NO: 35837 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agttacaagcaaatgaaaaa

SEQ ID NO: 35838 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttttcccactggggagttac

SEQ ID NO: 35839 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
caataccttttcccactggg

SEQ ID NO: 35840 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ggcaataccttttcccactg

SEQ ID NO: 35841 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aggcaataccttttcccact

SEQ ID NO: 35842 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
taggcaataccttttcccac

SEQ ID NO: 35843 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttgtggaggttaagtcccct

SEQ ID NO: 35844 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cttgtggaggttaagtcccc

SEQ ID NO: 35845 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agacaatccttgtggaggtt

SEQ ID NO: 35846 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tttttagacaatccttgtgg

SEQ ID NO: 35847 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gtttttagacaatccttgtg

SEQ ID NO: 35848 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttgtttttagacaatccttg

SEQ ID NO: 35849 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ccacagatatttcttgtttt

SEQ ID NO: 35850 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
taaggttagtgtttatacca

SEQ ID NO: 35851 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gaaaactgaagttttaaggt

SEQ ID NO: 35852 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
taccgaaaactgaagtttta

SEQ ID NO: 35853 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttaccgaaaactgaagtttt

SEQ ID NO: 35854 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gagtttgttaccgaaaactg

SEQ ID NO: 35855 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttgttaaagtgttttcagaa

SEQ ID NO: 35856 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttttgttaaagtgttttcag

SEQ ID NO: 35857 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cagttttgttaaagtgtttt

SEQ ID NO: 35858 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tttttcactcagttttgtta

SEQ ID NO: 35859 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aaagtcacttatttttcact

SEQ ID NO: 35860 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ctctctgttaatttttagta

SEQ ID NO: 35861 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ctcctctctctgttaatttt

SEQ ID NO: 35862 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tagatttattttaataaagc

SEQ ID NO: 35863 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atcttagatttattttaata

SEQ ID NO: 35864 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
atttctactatttagaatct

SEQ ID NO: 35865 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gatcaatgatttctactatt

SEQ ID NO: 35866 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttgttttctcaacggtcaag

SEQ ID NO: 35867 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atcttgttttctcaacggtc

SEQ ID NO: 35868 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
aagctatcttgttttctcaa

SEQ ID NO: 35869 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aattaatgagtaagaaagaa

SEQ ID NO: 35870 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aattgaattaatgagtaaga

SEQ ID NO: 35871 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aacaaattgaattaatgagt

SEQ ID NO: 35872 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
agtaaacaaattgaattaat

SEQ ID NO: 35873 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
agagaaggtgcttaatactt

SEQ ID NO: 35874 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tacaaggctttgcacagaga

SEQ ID NO: 35875 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttacaaggctttgcacagag

SEQ ID NO: 35876 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
attttacaaggctttgcaca

SEQ ID NO: 35877 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ccattttacaaggctttgca

SEQ ID NO: 35878 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tccacacagaccattttaca

SEQ ID NO: 35879 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atccacacagaccattttac

SEQ ID NO: 35880 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tgctgtagttgtaatccaca

SEQ ID NO: 35881 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aacaaggattcattgtgctg

SEQ ID NO: 35882 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
agatatgattaaatcaaaca

SEQ ID NO: 35883 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tagatatgattaaatcaaac

SEQ ID NO: 35884 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gacccttcattttctaatcc

SEQ ID NO: 35885 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ctagctagttaatgaattta

SEQ ID NO: 35886 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cctagctagttaatgaattt

SEQ ID NO: 35887 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gcctagctagttaatgaatt

SEQ ID NO: 35888 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aaagaatatccttgcctagc

SEQ ID NO: 35889 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tgggaaagaatatccttgcc

SEQ ID NO: 35890 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
taggagaattcctgatggga

SEQ ID NO: 35891 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aatttaggagaattcctgat

SEQ ID NO: 35892 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
caatttaggagaattcctga

SEQ ID NO: 35893 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
taaatatactagcaatttag

SEQ ID NO: 35894 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tataaatatactagcaattt

SEQ ID NO: 35895 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gtataaatatactagcaatt

SEQ ID NO: 35896 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gagttgttgtataaatatac

SEQ ID NO: 35897 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ataccagtattaaaactttt

SEQ ID NO: 35898 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttctgttttttcttttatac

SEQ ID NO: 35899 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gaacatgtgccttccatttc

SEQ ID NO: 35900 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gtccccagagatctggtttt

SEQ ID NO: 35901 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
acccattgtccccagagatc

SEQ ID NO: 35902 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tcccatacccattgtcccca

SEQ ID NO: 35903 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tttcccatacccattgtccc

SEQ ID NO: 35904 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gtagactctaagagagtttc

SEQ ID NO: 35905 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ataattcgtagactctaaga

SEQ ID NO: 35906 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
atataattcgtagactctaa

SEQ ID NO: 35907 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ctatataattcgtagactct

SEQ ID NO: 35908 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aaaaattcctatataattcg

SEQ ID NO: 35909 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
cgtttaggtctgtgattcat

SEQ ID NO: 35910 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cagttctaactctgacgttt

SEQ ID NO: 35911 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
acagttctaactctgacgtt

SEQ ID NO: 35912 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gatattttcttagaaattta

SEQ ID NO: 35913 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttttccctatgatattttct

SEQ ID NO: 35914 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gtgccaaatctaatgtctcg

SEQ ID NO: 35915 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tcttttgttgaccgtgcttt

SEQ ID NO: 35916 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aattttgacaaaatccaatt

SEQ ID NO: 35917 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tagtgttctttgatgcacaa

SEQ ID NO: 35918 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
attgccttttcactttctag

SEQ ID NO: 35919 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tggattgccttttcactttc

SEQ ID NO: 35920 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aattattttctcccatcata

SEQ ID NO: 35921 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tgccaatgttaatcccttat

SEQ ID NO: 35922 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tttattttttgttgaggagt

SEQ ID NO: 35923 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gtttattttttgttgaggag

SEQ ID NO: 35924 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cttgtttattttttgttgag

SEQ ID NO: 35925 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgcttgtttattttttgttg

SEQ ID NO: 35926 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctgcttgtttattttttgtt

SEQ ID NO: 35927 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
atgtactgattgactttctt

SEQ ID NO: 35928 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cccaaatgatcggtgatgtt

SEQ ID NO: 35929 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
atttgcatttcccaaatgat

SEQ ID NO: 35930 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tgtgaagtgatattttattg

SEQ ID NO: 35931 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
taaccatccgaccaagtgtg

SEQ ID NO: 35932 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
taaacaataaccatccgacc

SEQ ID NO: 35933 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ttcctatcagcaatgcacaa

SEQ ID NO: 35934 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
attcctatcagcaatgcaca

SEQ ID NO: 35935 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tattcctatcagcaatgcac

SEQ ID NO: 35936 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gcactattttatattcctat

SEQ ID NO: 35937 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
caccacagtgttttccacag

SEQ ID NO: 35938 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aaccaccacagtgttttcca

SEQ ID NO: 35939 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aattttttgaggaaccacca

SEQ ID NO: 35940 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tatttctgtttaattttttg

SEQ ID NO: 35941 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
atatttctgtttaatttttt

SEQ ID NO: 35942 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ataccctaaagtagaattgc

SEQ ID NO: 35943 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttaggatgtataccctaaag

SEQ ID NO: 35944 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgtttaggatgtatacccta

SEQ ID NO: 35945 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gtcccttctattaattgttt

SEQ ID NO: 35946 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cgtcccttctattaattgtt

SEQ ID NO: 35947 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ctgctatgaacattggtgta

SEQ ID NO: 35948 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
attagtgctgctatgaacat

SEQ ID NO: 35949 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cactttttggctactgtgat

SEQ ID NO: 35950 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tttgggttgttttcactttt

SEQ ID NO: 35951 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tcatctgttgatagacattt

SEQ ID NO: 35952 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttcatctgttgatagacatt

SEQ ID NO: 35953 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tttatctgttcatctgttga

SEQ ID NO: 35954 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tattcatttttaaggctgtg

SEQ ID NO: 35955 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cagaattttattcattttta

SEQ ID NO: 35956 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tcagaattttattcattttt

SEQ ID NO: 35957 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atccgggtcgtagcatatat

SEQ ID NO: 35958 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
caaggtgttcatccgggtcg

SEQ ID NO: 35959 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tgttttcaaggtgttcatcc

SEQ ID NO: 35960 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
atgttttcaaggtgttcatc

SEQ ID NO: 35961 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cacttagcataatgttttca

SEQ ID NO: 35962 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tcacttagcataatgttttc

SEQ ID NO: 35963 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
catgtctggcttatttcact

SEQ ID NO: 35964 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agcatttgtcttttcatgtc

SEQ ID NO: 35965 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ctcatgtaagtggaacccta

SEQ ID NO: 35966 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttctaggtacctcatgtaag

SEQ ID NO: 35967 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ctattctaggtacctcatgt

SEQ ID NO: 35968 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tctatgaatgtgactattct

SEQ ID NO: 35969 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ctctatgaatgtgactattc

SEQ ID NO: 35970 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tcctctcttcccctatcacc

SEQ ID NO: 35971 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
catcattccaaacaaaaact

SEQ ID NO: 35972 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cgatcaccaccatccatctt

SEQ ID NO: 35973 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atgtacagtttagaggtatt

SEQ ID NO: 35974 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
atttcaaatgtacagtttag

SEQ ID NO: 35975 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
catttcaaatgtacagttta

SEQ ID NO: 35976 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
accatttcaaatgtacagtt

SEQ ID NO: 35977 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttttaaccatttcaaatgta

SEQ ID NO: 35978 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gaatttaaaaatttatattt

SEQ ID NO: 35979 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttacggatctcaaaacacgc

SEQ ID NO: 35980 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
tactgactctttctgcctta

SEQ ID NO: 35981 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
cgcatgttgtcagggttgac

SEQ ID NO: 35982 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ggagacaccgcatgttgtca

SEQ ID NO: 35983 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aggagacaccgcatgttgtc

SEQ ID NO: 35984 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aaggagacaccgcatgttgt

SEQ ID NO: 35985 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctagcaaaacagataccaag

SEQ ID NO: 35986 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gcctagcaaaacagatacca

SEQ ID NO: 35987 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgcctagcaaaacagatacc

SEQ ID NO: 35988 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atgactactgcctagcaaaa

SEQ ID NO: 35989 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
agatataaatgactactgcc

SEQ ID NO: 35990 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
catgaaatagtggtactgca

SEQ ID NO: 35991 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gattatttctcatgaaatag

SEQ ID NO: 35992 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tatgattatttctcatgaaa

SEQ ID NO: 35993 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gaaacttaatggtgggagta

SEQ ID NO: 35994 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttttggaaacttaatggtgg

SEQ ID NO: 35995 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cattttggaaacttaatggt

SEQ ID NO: 35996 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gcattttggaaacttaatgg

SEQ ID NO: 35997 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tttgcattttggaaacttaa

SEQ ID NO: 35998 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aactttaaatgtttgcattt

SEQ ID NO: 35999 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aagacaaagattacaattga

SEQ ID NO: 36000 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ataagacaaagattacaatt

SEQ ID NO: 36001 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ggggcagggctaataagaca

SEQ ID NO: 36002 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gggcagggggcagggctaat

SEQ ID NO: 36003 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
actatttggggcagggggca

SEQ ID NO: 36004 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tactatttggggcagggggc

SEQ ID NO: 36005 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttactatttggggcaggggg

SEQ ID NO: 36006 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ctcttactatttggggcagg

SEQ ID NO: 36007 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cctcttactatttggggcag

SEQ ID NO: 36008 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
acctcttactatttggggca

SEQ ID NO: 36009 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aacctcttactatttggggc

SEQ ID NO: 36010 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gaacctcttactatttgggg

SEQ ID NO: 36011 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ttggaacctcttactatttg

SEQ ID NO: 36012 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cttggaacctcttactattt

SEQ ID NO: 36013 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tcttggaacctcttactatt

SEQ ID NO: 36014 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tctgtaatggattggattct

SEQ ID NO: 36015 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tcttcctgtctgtaatggat

SEQ ID NO: 36016 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tattctcttcctgtctgtaa

SEQ ID NO: 36017 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttttgtctttttttgtgatt

SEQ ID NO: 36018 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
accagaaaaaaatgtttgag

SEQ ID NO: 36019 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aaaaccagaaaaaaatgttt

SEQ ID NO: 36020 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ggacatgggtaacataaaac

SEQ ID NO: 36021 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ctggatctctttctggacat

SEQ ID NO: 36022 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
actggatctctttctggaca

SEQ ID NO: 36023 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tttttaactggatctctttc

SEQ ID NO: 36024 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tgagtgtgctcttttttaac

SEQ ID NO: 36025 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gtacaactttggaaagggat

SEQ ID NO: 36026 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
catgggtacaactttggaaa

SEQ ID NO: 36027 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gcatgggtacaactttggaa

SEQ ID NO: 36028 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agcatgggtacaactttgga

SEQ ID NO: 36029 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
taccagcatgggtacaactt

SEQ ID NO: 36030 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aatgctaaaattaccagcat

SEQ ID NO: 36031 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
caatgctaaaattaccagca

SEQ ID NO: 36032 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
taaaccaatgctaaaattac

SEQ ID NO: 36033 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ggattactaacctgcgtcga

SEQ ID NO: 36034 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gggattactaacctgcgtcg

SEQ ID NO: 36035 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
agggattactaacctgcgtc

SEQ ID NO: 36036 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gggtttttcttgattttgta

SEQ ID NO: 36037 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
agggtttttcttgattttgt

SEQ ID NO: 36038 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gagggtttttcttgattttg

SEQ ID NO: 36039 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
agattgaaagcagaagatga

SEQ ID NO: 36040 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aagattgaaagcagaagatg

SEQ ID NO: 36041 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
caagattgaaagcagaagat

SEQ ID NO: 36042 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gacagcaagattgaaagcag

SEQ ID NO: 36043 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
acagacagcaagattgaaag

SEQ ID NO: 36044 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aatacagacagcaagattga

SEQ ID NO: 36045 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atggttgaaatacagacagc

SEQ ID NO: 36046 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cagcatggttgaaatacaga

SEQ ID NO: 36047 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aaaccagcatggttgaaata

SEQ ID NO: 36048 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gagaagcaagaaaaccagca

SEQ ID NO: 36049 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttaaggagaagcaagaaaac

SEQ ID NO: 36050 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgatgtatttaaggagaagc

SEQ ID NO: 36051 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tatttgatgtatttaaggag

SEQ ID NO: 36052 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gcatatttgatgtatttaag

SEQ ID NO: 36053 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aggcatatttgatgtattta

SEQ ID NO: 36054 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaggcatatttgatgtattt

SEQ ID NO: 36055 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cagcaattgcaaaagcccta

SEQ ID NO: 36056 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
acagcaattgcaaaagccct

SEQ ID NO: 36057 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
acaaaaaacagcaattgcaa

SEQ ID NO: 36058 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atcattctagtcacaaaaaa

SEQ ID NO: 36059 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aaacaactgaagaatcattc

SEQ ID NO: 36060 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gggagctagctaaacaactg

SEQ ID NO: 36061 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aaatgaaaaactaagggagc

SEQ ID NO: 36062 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aagtaaatgaaaaactaagg

SEQ ID NO: 36063 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tgaagtaaatgaaaaactaa

SEQ ID NO: 36064 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
atgaagtaaatgaaaaacta

SEQ ID NO: 36065 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
catgaagtaaatgaaaaact

SEQ ID NO: 36066 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ggtatttgagtagagacatg

SEQ ID NO: 36067 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttatacagggtatttgagta

SEQ ID NO: 36068 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttttatacagggtatttgag

SEQ ID NO: 36069 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aaattttatacagggtattt

SEQ ID NO: 36070 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ggtctgaaaaattttataca

SEQ ID NO: 36071 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tggtctgaaaaattttatac

SEQ ID NO: 36072 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gtggtctgaaaaattttata

SEQ ID NO: 36073 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gaaggaggtattatttaaag

SEQ ID NO: 36074 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agagaaggaggtattattta

SEQ ID NO: 36075 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gacagagaattgagagaagg

SEQ ID NO: 36076 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ggacagagaattgagagaag

SEQ ID NO: 36077 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
caggacagagaattgagaga

SEQ ID NO: 36078 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
acaggacagagaattgagag

SEQ ID NO: 36079 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aaaacaggacagagaattga

SEQ ID NO: 36080 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ataaaacaggacagagaatt

SEQ ID NO: 36081 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aaaaacaataaaacaggaca

SEQ ID NO: 36082 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tgaaaaacaataaaacagga

SEQ ID NO: 36083 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gctgtgaaaaacaataaaac

SEQ ID NO: 36084 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tgctgtgaaaaacaataaaa

SEQ ID NO: 36085 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
actatccatcattgtaccat

SEQ ID NO: 36086 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cgattttaagagataatgaa

SEQ ID NO: 36087 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gccgattttaagagataatg

SEQ ID NO: 36088 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
agatgtgacgccgattttaa

SEQ ID NO: 36089 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ggagatgtgacgccgatttt

SEQ ID NO: 36090 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
atagcaatgaacaacacatg

SEQ ID NO: 36091 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
atatagcaatgaacaacaca

SEQ ID NO: 36092 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tttattgtagacatcagata

SEQ ID NO: 36093 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
taaagttttattgtagacat

SEQ ID NO: 36094 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttcttcataaagttttattg

SEQ ID NO: 36095 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ccctctcttccttcttcata

SEQ ID NO: 36096 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atactcttcctggaatttaa

SEQ ID NO: 36097 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ctcagcatttatactcttcc

SEQ ID NO: 36098 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
actcacaacctcactcctct

SEQ ID NO: 36099 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agtccctccaggccagttcc

SEQ ID NO: 36100 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gctgctgagtccctccaggc

SEQ ID NO: 36101 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
agcggctgctgagtccctcc

SEQ ID NO: 36102 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aagcggctgctgagtccctc

SEQ ID NO: 36103 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ggcagtggtaagcggctgct

SEQ ID NO: 36104 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
atcccaagggcagtggtaag

SEQ ID NO: 36105 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gagatcccaagggcagtggt

SEQ ID NO: 36106 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ggcagagatcccaagggcag

SEQ ID NO: 36107 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cctggcagagatcccaaggg

SEQ ID NO: 36108 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
agacctggcagagatcccaa

SEQ ID NO: 36109 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aagacctggcagagatccca

SEQ ID NO: 36110 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gaagacctggcagagatccc

SEQ ID NO: 36111 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tagggagggaagacctggca

SEQ ID NO: 36112 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tgtagggagggaagacctgg

SEQ ID NO: 36113 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gtttgtagggagggaagacc

SEQ ID NO: 36114 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
attgaggtttgtagggaggg

SEQ ID NO: 36115 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gccattgaggtttgtaggga

SEQ ID NO: 36116 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgccattgaggtttgtaggg

SEQ ID NO: 36117 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gtgccattgaggtttgtagg

SEQ ID NO: 36118 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tggtgccattgaggtttgta

SEQ ID NO: 36119 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttggtgccattgaggtttgt

SEQ ID NO: 36120 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
attggtgccattgaggtttg

SEQ ID NO: 36121 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
agttggtattggtgccattg

SEQ ID NO: 36122 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aagttggtattggtgccatt

SEQ ID NO: 36123 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gttggcatccaagttggtat

SEQ ID NO: 36124 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tcaggagttggcatccaagt

SEQ ID NO: 36125 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
taggtcaggagttggcatcc

SEQ ID NO: 36126 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aaaatgtgtaggtcaggagt

SEQ ID NO: 36127 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctccaaaatgtgtaggtcag

SEQ ID NO: 36128 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gcctccaaaatgtgtaggtc

SEQ ID NO: 36129 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ggcctccaaaatgtgtaggt

SEQ ID NO: 36130 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
agttggcctccaaaatgtgt

SEQ ID NO: 36131 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tagttggcctccaaaatgtg

SEQ ID NO: 36132 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
atcattagatccggtctagt

SEQ ID NO: 36133 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
attaatcattagatccggtc

SEQ ID NO: 36134 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
tagggattaatcattagatc

SEQ ID NO: 36135 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttagcctagggattaatcat

SEQ ID NO: 36136 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aactgatttatcttagccta

SEQ ID NO: 36137 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
caactgatttatcttagcct

SEQ ID NO: 36138 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ccaactgatttatcttagcc

SEQ ID NO: 36139 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aatttccaactgatttatct

SEQ ID NO: 36140 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gataagaaaaaacaaagtta

SEQ ID NO: 36141 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ctggcagataagaaaaaaca

SEQ ID NO: 36142 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
taacaggtagactggcagat

SEQ ID NO: 36143 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atgcttaacaggtagactgg

SEQ ID NO: 36144 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gatatgcttaacaggtagac

SEQ ID NO: 36145 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tgacagatatgcttaacagg

SEQ ID NO: 36146 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cagtgacagatatgcttaac

SEQ ID NO: 36147 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
acagtgacagatatgcttaa

SEQ ID NO: 36148 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
acgaaaacttttgacagtga

SEQ ID NO: 36149 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
agggacacgaaaacttttga

SEQ ID NO: 36150 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tgctaagtgaaataagtaaa

SEQ ID NO: 36151 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
atgctaagtgaaataagtaa

SEQ ID NO: 36152 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
catgctaagtgaaataagta

SEQ ID NO: 36153 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agagacatgctaagtgaaat

SEQ ID NO: 36154 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ggacctagaagagacatgct

SEQ ID NO: 36155 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cagcatgcatggacctagaa

SEQ ID NO: 36156 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gacagcatgcatggacctag

SEQ ID NO: 36157 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tgtgacagcatgcatggacc

SEQ ID NO: 36158 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
actatttgtgacagcatgca

SEQ ID NO: 36159 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ggaaatcttactatttgtga

SEQ ID NO: 36160 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tatctagccttaaaaaaaga

SEQ ID NO: 36161 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttatctagccttaaaaaaag

SEQ ID NO: 36162 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atattatctagccttaaaaa

SEQ ID NO: 36163 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
atataaaatagaatattatc

SEQ ID NO: 36164 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aatgtggtctgtatataaaa

SEQ ID NO: 36165 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ataaaagagtaaagaaaatg

SEQ ID NO: 36166 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
catcaacagataaaagagta

SEQ ID NO: 36167 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
atgatcatcaacagataaaa

SEQ ID NO: 36168 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaatgatcatcaacagataa

SEQ ID NO: 36169 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
acaacccaaatgatcatcaa

SEQ ID NO: 36170 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tactgcagcattattcacaa

SEQ ID NO: 36171 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atgcacttctgtgtttactg

SEQ ID NO: 36172 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
attgaaatcagaatctcaaa

SEQ ID NO: 36173 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
caattgaaatcagaatctca

SEQ ID NO: 36174 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tatgatccagcaattgaaat

SEQ ID NO: 36175 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aatagaactaccatatgatc

SEQ ID NO: 36176 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gttcctcaaaaaattaaaaa

SEQ ID NO: 36177 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgctatggaaaataatatgg

SEQ ID NO: 36178 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agctgctatggaaaataata

SEQ ID NO: 36179 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gtataatagtgtagctgcta

SEQ ID NO: 36180 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ggtgggaatgtataatagtg

SEQ ID NO: 36181 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ctgttggtgggaatgtataa

SEQ ID NO: 36182 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aagcattgtccactgttggt

SEQ ID NO: 36183 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aaagcattgtccactgttgg

SEQ ID NO: 36184 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
atgaaagcattgtccactgt

SEQ ID NO: 36185 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgagaatgtgaagaaaatga

SEQ ID NO: 36186 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaggtgttgttgagaatgtg

SEQ ID NO: 36187 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aaaaagtgaaaggtgttgtt

SEQ ID NO: 36188 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ggctgttataaaaaagtgaa

SEQ ID NO: 36189 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tggctgttataaaaaagtga

SEQ ID NO: 36190 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttaagatggctgttataaaa

SEQ ID NO: 36191 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tcatctcacacctgttaaga

SEQ ID NO: 36192 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ataatcatctcacacctgtt

SEQ ID NO: 36193 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ggttttatcagcactgcaat

SEQ ID NO: 36194 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ctaagtggttaaggttttat

SEQ ID NO: 36195 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tcctctagactaagtggtta

SEQ ID NO: 36196 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atcctctagactaagtggtt

SEQ ID NO: 36197 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agcttatcctctagactaag

SEQ ID NO: 36198 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ggtagcttatcctctagact

SEQ ID NO: 36199 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tggattggtagcttatcctc

SEQ ID NO: 36200 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tttagtgatttgtggattgg

SEQ ID NO: 36201 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tattttagtgatttgtggat

SEQ ID NO: 36202 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
caatctattttagtgatttg

SEQ ID NO: 36203 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tgatacgtctcaatctattt

SEQ ID NO: 36204 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ccatgggaaatttggccctt

SEQ ID NO: 36205 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tataaaaaccatgggaaatt

SEQ ID NO: 36206 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ctttgggatataaaaaccat

SEQ ID NO: 36207 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
actttgggatataaaaacca

SEQ ID NO: 36208 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ccacttagatactgtacttt

SEQ ID NO: 36209 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tccacttagatactgtactt

SEQ ID NO: 36210 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttaaatatctattatccact

SEQ ID NO: 36211 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
taagggttttaaaacagttt

SEQ ID NO: 36212 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gacttttaagggttttaaaa

SEQ ID NO: 36213 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tgcaagaagttgacttttaa

SEQ ID NO: 36214 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
atgcaagaagttgactttta

SEQ ID NO: 36215 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aatgcaagaagttgactttt

SEQ ID NO: 36216 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tctaacatcagtaatgcaag

SEQ ID NO: 36217 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttgtctaacatcagtaatgc

SEQ ID NO: 36218 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tcagttaaattgtctaacat

SEQ ID NO: 36219 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gaagactcaattatctaagt

SEQ ID NO: 36220 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tcatgaagactcaattatct

SEQ ID NO: 36221 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tcacagtacttattgtcatg

SEQ ID NO: 36222 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cacaaatgaaacctaaatca

SEQ ID NO: 36223 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tggaggagtacaaatattta

SEQ ID NO: 36224 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
attggaggagtacaaatatt

SEQ ID NO: 36225 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttagatattctatattggag

SEQ ID NO: 36226 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
atttagatattctatattgg

SEQ ID NO: 36227 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aatttagatattctatattg

SEQ ID NO: 36228 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aaaatttagatattctatat

SEQ ID NO: 36229 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tatcttggaaaataaaaatt

SEQ ID NO: 36230 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttggaagtatttatatatct

SEQ ID NO: 36231 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aagatgatggtgttcattgg

SEQ ID NO: 36232 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gataagatgatggtgttcat

SEQ ID NO: 36233 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tcttgtgcaggataagatga

SEQ ID NO: 36234 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaagtgatcttgtgcaggat

SEQ ID NO: 36235 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aaagcaaagtgatcttgtgc

SEQ ID NO: 36236 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aaaagcaaagtgatcttgtg

SEQ ID NO: 36237 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atggagaagtatgaaaagca

SEQ ID NO: 36238 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agcagatggagaagtatgaa

SEQ ID NO: 36239 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cctggagctagcagatggag

SEQ ID NO: 36240 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gatcctggagctagcagatg

SEQ ID NO: 36241 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gagatcctggagctagcaga

SEQ ID NO: 36242 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cgttgagatcctggagctag

SEQ ID NO: 36243 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
acacgttgagatcctggagc

SEQ ID NO: 36244 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttacacacgttgagatcctg

SEQ ID NO: 36245 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agttacacacgttgagatcc

SEQ ID NO: 36246 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ggaatgaagttacacacgtt

SEQ ID NO: 36247 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tggagaagaaacagggaatg

SEQ ID NO: 36248 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tctgaaatggagaagaaaca

SEQ ID NO: 36249 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttctgaaatggagaagaaac

SEQ ID NO: 36250 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
attctgaaatggagaagaaa

SEQ ID NO: 36251 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aagtttattctgaaatggag

SEQ ID NO: 36252 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
atgaagtttattctgaaatg

SEQ ID NO: 36253 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ggatgaagtttattctgaaa

SEQ ID NO: 36254 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttaaaaaaatgtctaggatg

SEQ ID NO: 36255 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aaaaaattaaaaaaatgtct

SEQ ID NO: 36256 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aaaaaaattaaaaaaatgtc

SEQ ID NO: 36257 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
acagagcgagactcagtctc

SEQ ID NO: 36258 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ctgggcaacagagcgagact

SEQ ID NO: 36259 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tcctgcctgggcaacagagc

SEQ ID NO: 36260 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gcactcctgcctgggcaaca

SEQ ID NO: 36261 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ctgcactcctgcctgggcaa

SEQ ID NO: 36262 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gagccactgcactcctgcct

SEQ ID NO: 36263 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
cgagccactgcactcctgcc

SEQ ID NO: 36264 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ggttgcagtgagctgagatc

SEQ ID NO: 36265 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gatggaggttgcagtgagct

SEQ ID NO: 36266 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tgggagatggaggttgcagt

SEQ ID NO: 36267 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aacctgggagatggaggttg

SEQ ID NO: 36268 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgcctgaacctgggagatgg

SEQ ID NO: 36269 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttgcctgaacctgggagatg

SEQ ID NO: 36270 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aattgcctgaacctgggaga

SEQ ID NO: 36271 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ggagaattgcctgaacctgg

SEQ ID NO: 36272 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
caggagaattgcctgaacct

SEQ ID NO: 36273 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gcaggagaattgcctgaacc

SEQ ID NO: 36274 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttctcgggaggctgaggcag

SEQ ID NO: 36275 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gcttctcgggaggctgaggc

SEQ ID NO: 36276 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
agcttctcgggaggctgagg

SEQ ID NO: 36277 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cccagcttctcgggaggctg

SEQ ID NO: 36278 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tcccagcttctcgggaggct

SEQ ID NO: 36279 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgtagtcccagcttctcggg

SEQ ID NO: 36280 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctgtagtcccagcttctcgg

SEQ ID NO: 36281 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
acctgtagtcccagcttctc

SEQ ID NO: 36282 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
cacctgtagtcccagcttct

SEQ ID NO: 36283 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gtggccagcacctgtagtcc

SEQ ID NO: 36284 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ggcatggtggccagcacctg

SEQ ID NO: 36285 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aactatccaggcatggtggc

SEQ ID NO: 36286 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
caaaaactatccaggcatgg

SEQ ID NO: 36287 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
atacaaaaactatccaggca

SEQ ID NO: 36288 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aaaaaatacaaaaactatcc

SEQ ID NO: 36289 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aaaaaaatacaaaaactatc

SEQ ID NO: 36290 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ggagaccagcctggtcaaca

SEQ ID NO: 36291 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tcaggagttggagaccagcc

SEQ ID NO: 36292 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tgaggtcaggagttggagac

SEQ ID NO: 36293 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tcacttgaggtcaggagttg

SEQ ID NO: 36294 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gatcacttgaggtcaggagt

SEQ ID NO: 36295 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ggctgatcacttgaggtcag

SEQ ID NO: 36296 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
caggctgatcacttgaggtc

SEQ ID NO: 36297 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gcaggctgatcacttgaggt

SEQ ID NO: 36298 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgaggcaggctgatcacttg

SEQ ID NO: 36299 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctgaggcaggctgatcactt

SEQ ID NO: 36300 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gcactttggaaggctgaggc

SEQ ID NO: 36301 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
agcactttggaaggctgagg

SEQ ID NO: 36302 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tccagcactttggaaggctg

SEQ ID NO: 36303 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
atccagcactttggaaggct

SEQ ID NO: 36304 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ccgtaatccagcactttgga

SEQ ID NO: 36305 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cccgtaatccagcactttgg

SEQ ID NO: 36306 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
acgcccgtaatccagcactt

SEQ ID NO: 36307 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ggtggcttacgcccgtaatc

SEQ ID NO: 36308 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ctagggtgggccaggcgcgg

SEQ ID NO: 36309 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
tgtctagggtgggccaggcg

SEQ ID NO: 36310 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
taaaatgtctagggtgggcc

SEQ ID NO: 36311 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ataaaatgtctagggtgggc

SEQ ID NO: 36312 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
atgtataaaatgtctagggt

SEQ ID NO: 36313 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tatgtataaaatgtctaggg

SEQ ID NO: 36314 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aaatatgtataaaatgtcta

SEQ ID NO: 36315 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gaaatatgtataaaatgtct

SEQ ID NO: 36316 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ggaaatatgtataaaatgtc

SEQ ID NO: 36317 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gaggaatggtgtaattaaaa

SEQ ID NO: 36318 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
agaggaatggtgtaattaaa

SEQ ID NO: 36319 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aagaggaatggtgtaattaa

SEQ ID NO: 36320 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aagatttgaaaaaagaggaa

SEQ ID NO: 36321 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tagaaaagatttgaaaaaag

SEQ ID NO: 36322 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gtagaaaagatttgaaaaaa

SEQ ID NO: 36323 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aggtagaaaagatttgaaaa

SEQ ID NO: 36324 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aggccttccccaaggtagaa

SEQ ID NO: 36325 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gaaaaaggccttccccaagg

SEQ ID NO: 36326 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgggaaaaaggccttcccca

SEQ ID NO: 36327 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atgggaaaaaggccttcccc

SEQ ID NO: 36328 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aaaaaactgaaatgggaaaa

SEQ ID NO: 36329 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
taaaaaactgaaatgggaaa

SEQ ID NO: 36330 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
taacattaaaaaactgaaat

SEQ ID NO: 36331 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttaacattaaaaaactgaaa

SEQ ID NO: 36332 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
acttcactttcctggtctag

SEQ ID NO: 36333 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgacttcactttcctggtct

SEQ ID NO: 36334 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
atgacttcactttcctggtc

SEQ ID NO: 36335 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gttgaatgacttcactttcc

SEQ ID NO: 36336 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgtttttgaagttgttttat

SEQ ID NO: 36337 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gtgtttttgaagttgtttta

SEQ ID NO: 36338 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atgcatttaaagtgtttttg

SEQ ID NO: 36339 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaagagtacctatgcattta

SEQ ID NO: 36340 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gtttgaagacattatgaaaa

SEQ ID NO: 36341 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aagtttgaagacattatgaa

SEQ ID NO: 36342 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gagattttggtggaagtttg

SEQ ID NO: 36343 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
caaaatagagattttggtgg

SEQ ID NO: 36344 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agtcaaaatagagattttgg

SEQ ID NO: 36345 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttaagtcaaaatagagattt

SEQ ID NO: 36346 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tattgtgttaagtcaaaata

SEQ ID NO: 36347 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tatattgtgttaagtcaaaa

SEQ ID NO: 36348 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cctgaggggtatattgtgtt

SEQ ID NO: 36349 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cttggacaccaattcctgag

SEQ ID NO: 36350 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tcttggacaccaattcctga

SEQ ID NO: 36351 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttcttggacaccaattcctg

SEQ ID NO: 36352 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cttcttggacaccaattcct

SEQ ID NO: 36353 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gactgtttcaattttcttct

SEQ ID NO: 36354 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aaacaacaaaaaaagaaaga

SEQ ID NO: 36355 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tagaaaacaacaaaaaaaga

SEQ ID NO: 36356 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ctaatagaaaacaacaaaaa

SEQ ID NO: 36357 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aatcatgtaattacagctaa

SEQ ID NO: 36358 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
catactaaatcatgtaatta

SEQ ID NO: 36359 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aatatgtttaacccttaatg

SEQ ID NO: 36360 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
caaatatgtttaacccttaa

SEQ ID NO: 36361 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tacctggtggttacgctacc

SEQ ID NO: 36362 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ccccacacagatatacctgg

SEQ ID NO: 36363 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ataccccacacagatatacc

SEQ ID NO: 36364 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
acgtttgcacataccccaca

SEQ ID NO: 36365 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaagaaatcttatatattcc

SEQ ID NO: 36366 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tacacatttcttttatagga

SEQ ID NO: 36367 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aacatacacatttcttttat

SEQ ID NO: 36368 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
taacatacacatttctttta

SEQ ID NO: 36369 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
acctttccaaagactcacaa

SEQ ID NO: 36370 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gaaattacctaacctttcca

SEQ ID NO: 36371 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gaggtgagaacactaaggct

SEQ ID NO: 36372 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
catttgaggtgagaacacta

SEQ ID NO: 36373 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ccatttgaggtgagaacact

SEQ ID NO: 36374 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tcatgaccaccatttgaggt

SEQ ID NO: 36375 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
atcctcatgaccaccatttg

SEQ ID NO: 36376 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aatcctcatgaccaccattt

SEQ ID NO: 36377 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ctaactgagcagtttgttaa

SEQ ID NO: 36378 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gctaactgagcagtttgtta

SEQ ID NO: 36379 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgctaactgagcagtttgtt

SEQ ID NO: 36380 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tctccttaatgctaactgag

SEQ ID NO: 36381 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
acgtctccttaatgctaact

SEQ ID NO: 36382 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
taatgtaacagtcttatgta

SEQ ID NO: 36383 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tactgataatattaatgtaa

SEQ ID NO: 36384 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaggaaaaatacatacggaa

SEQ ID NO: 36385 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
gttacaaggaaaaatacata

SEQ ID NO: 36386 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ccagcaattatgctgttaca

SEQ ID NO: 36387 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gccagcaattatgctgttac

SEQ ID NO: 36388 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tgtaagccactgtgcaaggc

SEQ ID NO: 36389 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
caggtgtaagccactgtgca

SEQ ID NO: 36390 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
acaggtgtaagccactgtgc

SEQ ID NO: 36391 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agtgttgggattacaggtgt

SEQ ID NO: 36392 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttctaaagtgttgggattac

SEQ ID NO: 36393 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cttctaaagtgttgggatta

SEQ ID NO: 36394 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cctcggccttctaaagtgtt

SEQ ID NO: 36395 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
acctcggccttctaaagtgt

SEQ ID NO: 36396 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ctgcccacctcggccttcta

SEQ ID NO: 36397 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
ctcaggtgatctgcccacct

SEQ ID NO: 36398 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
agtctcgaattcctgacctc

SEQ ID NO: 36399 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tagtctcgaattcctgacct

SEQ ID NO: 36400 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tttcaccatgttggccagac

SEQ ID NO: 36401 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tggggtttcaccatgttggc

SEQ ID NO: 36402 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gagatggggtttcaccatgt

SEQ ID NO: 36403 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ttgcagttttagtagagatg

SEQ ID NO: 36404 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tttgcagttttagtagagat

SEQ ID NO: 36405 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttttgcagttttagtagaga

SEQ ID NO: 36406 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctaattttgcagttttagta

SEQ ID NO: 36407 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ggctaattttgcagttttag

SEQ ID NO: 36408 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cccggctaattttgcagttt

SEQ ID NO: 36409 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
accatgcccggctaattttg

SEQ ID NO: 36410 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
caggcatgtaccaccatgcc

SEQ ID NO: 36411 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tcccaagtagctgggattac

SEQ ID NO: 36412 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ctcccaagtagctgggatta

SEQ ID NO: 36413 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cctcagcctcccaagtagct

SEQ ID NO: 36414 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gcctcagcctcccaagtagc

SEQ ID NO: 36415 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tcctgcctcagcctcccaag

SEQ ID NO: 36416 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttctcctgcctcagcctccc

SEQ ID NO: 36417 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttcaagtgattctcctgcct

SEQ ID NO: 36418 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aacctctgcctcccagattc

SEQ ID NO: 36419 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tcgctgcaacctctgcctcc

SEQ ID NO: 36420 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ggagtgcagtggtacgatgt

SEQ ID NO: 36421 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttgcccaggctggagtgcag

SEQ ID NO: 36422 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ctgttgcccaggctggagtg

SEQ ID NO: 36423 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tcactctgttgcccaggctg

SEQ ID NO: 36424 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tttcactctgttgcccaggc

SEQ ID NO: 36425 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ccggtttcactctgttgccc

SEQ ID NO: 36426 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gccggtttcactctgttgcc

SEQ ID NO: 36427 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
ttacataggtaaaggtgtgc

SEQ ID NO: 36428 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
caggttttttacataggtaa

SEQ ID NO: 36429 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gcaggttttttacataggta

SEQ ID NO: 36430 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gatgtgcaggttttttacat

SEQ ID NO: 36431 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ggatgtgcaggttttttaca

SEQ ID NO: 36432 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ggtacatttgcaggatgtgc

SEQ ID NO: 36433 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aggtacatttgcaggatgtg

SEQ ID NO: 36434 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aagtttcaaggtacatttgc

SEQ ID NO: 36435 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
taagtttcaaggtacatttg

SEQ ID NO: 36436 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttttttttaattaagtttca

SEQ ID NO: 36437 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tttttttttaattaagtttc

SEQ ID NO: 36438 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttttttttttttttttaatt

SEQ ID NO: 36439 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
taggcgtgagccaccatgcc

SEQ ID NO: 36440 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
agtgctgggattataggcgt

SEQ ID NO: 36441 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ccccaaagtgctgggattat

SEQ ID NO: 36442 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cccccaaagtgctgggatta

SEQ ID NO: 36443 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cctaggccccccaaagtgct

SEQ ID NO: 36444 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gcctaggccccccaaagtgc

SEQ ID NO: 36445 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ctgcccgcctaggcccccca

SEQ ID NO: 36446 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttcaggtgatctgcccgcct

SEQ ID NO: 36447 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gttcaggtgatctgcccgcc

SEQ ID NO: 36448 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ggtcttgaactcctgagttc

SEQ ID NO: 36449 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tggtcttgaactcctgagtt

SEQ ID NO: 36450 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
caggctggtcttgaactcct

SEQ ID NO: 36451 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tttcaccaggttgggcaggc

SEQ ID NO: 36452 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aggatttcaccaggttgggc

SEQ ID NO: 36453 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
taggatttcaccaggttggg

SEQ ID NO: 36454 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
agataggatttcaccaggtt

SEQ ID NO: 36455 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gagataggatttcaccaggt

SEQ ID NO: 36456 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
agtagagataggatttcacc

SEQ ID NO: 36457 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tagtagagataggatttcac

SEQ ID NO: 36458 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tttgtatttttagtagagat

SEQ ID NO: 36459 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttttgtatttttagtagaga

SEQ ID NO: 36460 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctaattttgtatttttagta

SEQ ID NO: 36461 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ggctaattttgtatttttag

SEQ ID NO: 36462 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cctggctaattttgtatttt

SEQ ID NO: 36463 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
caggcatgagccacctcgcc

SEQ ID NO: 36464 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gtagccgggattacaggcat

SEQ ID NO: 36465 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tcccgagtagccgggattac

SEQ ID NO: 36466 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ctcccgagtagccgggatta

SEQ ID NO: 36467 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cctcagcctcccgagtagcc

SEQ ID NO: 36468 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
gcctcagcctcccgagtagc

SEQ ID NO: 36469 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tcctgcctcagcctcccgag

SEQ ID NO: 36470 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttctcctgcctcagcctccc

SEQ ID NO: 36471 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttcaagcaattctcctgcct

SEQ ID NO: 36472 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aacttccgcctcccaggttc

SEQ ID NO: 36473 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cactgcaacttccgcctccc

SEQ ID NO: 36474 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tcactgcaacttccgcctcc

SEQ ID NO: 36475 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ggagtgcaatggtacgatct

SEQ ID NO: 36476 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttgcccaggctggagtgcaa

SEQ ID NO: 36477 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cactcttgttgcccaggctg

SEQ ID NO: 36478 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttcactcttgttgcccaggc

SEQ ID NO: 36479 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gagtttcactcttgttgccc

SEQ ID NO: 36480 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cgagtttcactcttgttgcc

SEQ ID NO: 36481 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttttttttttttttgagacc

SEQ ID NO: 36482 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gcattctttttttttttttt

SEQ ID NO: 36483 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tatctaggcatttaataact

SEQ ID NO: 36484 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gatgttcaataatggtatct

SEQ ID NO: 36485 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
agatgttcaataatggtatc

SEQ ID NO: 36486 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tatgagtagatgttcaataa

SEQ ID NO: 36487 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
acatgataagtagatatgag

SEQ ID NO: 36488 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tacacatgataagtagatat

SEQ ID NO: 36489 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
agtgtcttacacatgataag

SEQ ID NO: 36490 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tttagtgtcttacacatgat

SEQ ID NO: 36491 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tttttccaaaacagccactt

SEQ ID NO: 36492 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gtaatttgttttttccaaaa

SEQ ID NO: 36493 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tagagtatattatatattag

SEQ ID NO: 36494 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tatagagtatattatatatt

SEQ ID NO: 36495 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
atatagagtatattatatat

SEQ ID NO: 36496 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tatattatatgttatatata

SEQ ID NO: 36497 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
actatattatatgttatata

SEQ ID NO: 36498 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
attagtagtatttacttcta

SEQ ID NO: 36499 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aattagtagtatttacttct

SEQ ID NO: 36500 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
attgctttcctgtaaattag

SEQ ID NO: 36501 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aatattgctttcctgtaaat

SEQ ID NO: 36502 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ctttactcagtatgtggtct

SEQ ID NO: 36503 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tatttcctttactcagtatg

SEQ ID NO: 36504 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tcccaaatatttcctttact

SEQ ID NO: 36505 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
caaattagtatagtgaaagg

SEQ ID NO: 36506 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gttcaaattagtatagtgaa

SEQ ID NO: 36507 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agttcaaattagtatagtga

SEQ ID NO: 36508 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aatttgagttcaaattagta

SEQ ID NO: 36509 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aaataaatttgagttcaaat

SEQ ID NO: 36510 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aagcacagataaataaattt

SEQ ID NO: 36511 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tttataaagtgttaaaagca

SEQ ID NO: 36512 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atatttttataaagtgttaa

SEQ ID NO: 36513 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gactgtaaaatatttttata

SEQ ID NO: 36514 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
attacatctctactatattt

SEQ ID NO: 36515 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgtagaacagctaggcagag

SEQ ID NO: 36516 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
acttgtagaacagctaggca

SEQ ID NO: 36517 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
acacttgtagaacagctagg

SEQ ID NO: 36518 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgaacacttgtagaacagct

SEQ ID NO: 36519 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
atgaacacttgtagaacagc

SEQ ID NO: 36520 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aggaatgaacacttgtagaa

SEQ ID NO: 36521 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cttttaggaatgaacacttg

SEQ ID NO: 36522 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
agatcagctgacagactttt

SEQ ID NO: 36523 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gagatcagctgacagacttt

SEQ ID NO: 36524 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aatcccatgagatcagctga

SEQ ID NO: 36525 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttcttataatcccatgagat

SEQ ID NO: 36526 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
taaggttcttataatcccat

SEQ ID NO: 36527 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tcagggatcaactgggaata

SEQ ID NO: 36528 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ctcagggatcaactgggaat

SEQ ID NO: 36529 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ggcctactcagggatcaact

SEQ ID NO: 36530 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tggcctactcagggatcaac

SEQ ID NO: 36531 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aaagggaagtggcctactca

SEQ ID NO: 36532 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aaaagggaagtggcctactc

SEQ ID NO: 36533 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aaaaagggaagtggcctact

SEQ ID NO: 36534 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tcaggtaggaaaaagggaag

SEQ ID NO: 36535 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aattcaggtaggaaaaaggg

SEQ ID NO: 36536 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ggtaattcaggtaggaaaaa

SEQ ID NO: 36537 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tggtaattcaggtaggaaaa

SEQ ID NO: 36538 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atggtaattcaggtaggaaa

SEQ ID NO: 36539 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tggctcatggtaattcaggt

SEQ ID NO: 36540 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttggctcatggtaattcagg

SEQ ID NO: 36541 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aacttggctcatggtaattc

SEQ ID NO: 36542 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aaacttggctcatggtaatt

SEQ ID NO: 36543 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ccatttacaaacttggctca

SEQ ID NO: 36544 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tgttaccccatttacaaact

SEQ ID NO: 36545 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aacaaaatattataaagttg

SEQ ID NO: 36546 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gcatggaacaaaatattata

SEQ ID NO: 36547 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ctttgtaaatgatctttgca

SEQ ID NO: 36548 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tccttctaggtaaatattat

SEQ ID NO: 36549 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttccttctaggtaaatatta

SEQ ID NO: 36550 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttatctgagtgattccttct

SEQ ID NO: 36551 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tttatctgagtgattccttc

SEQ ID NO: 36552 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ggtaagtgatgcctttatct

SEQ ID NO: 36553 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gaattaaatgctttattggt

SEQ ID NO: 36554 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ggatgaattaaatgctttat

SEQ ID NO: 36555 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttattgaggacattttgaat

SEQ ID NO: 36556 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tttattgaggacattttgaa

SEQ ID NO: 36557 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
agagtaaagataatttattg

SEQ ID NO: 36558 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cagagtaaagataatttatt

SEQ ID NO: 36559 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atcttttagggctcagagta

SEQ ID NO: 36560 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
agtgtatcttttagggctca

SEQ ID NO: 36561 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
acagtgtatcttttagggct

SEQ ID NO: 36562 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aatagacagtgtatctttta

SEQ ID NO: 36563 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
taatagacagtgtatctttt

SEQ ID NO: 36564 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ctaatagacagtgtatcttt

SEQ ID NO: 36565 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
attctttcaagtctaataga

SEQ ID NO: 36566 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gactattctttcaagtctaa

SEQ ID NO: 36567 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tactaaatgactattctttc

SEQ ID NO: 36568 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tatatttcatatattgattt

SEQ ID NO: 36569 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
agatcagcctgggcaataaa

SEQ ID NO: 36570 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tagatcagcctgggcaataa

SEQ ID NO: 36571 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
caggagttctagatcagcct

SEQ ID NO: 36572 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ccaggagttctagatcagcc

SEQ ID NO: 36573 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttgatccaggagttctagat

SEQ ID NO: 36574 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
attgcttgatccaggagttc

SEQ ID NO: 36575 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tggaggattgcttgatccag

SEQ ID NO: 36576 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gctggaggattgcttgatcc

SEQ ID NO: 36577 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ggctggaggattgcttgatc

SEQ ID NO: 36578 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ctttgggaggccgaggctgg

SEQ ID NO: 36579 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
actttgggaggccgaggctg

SEQ ID NO: 36580 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tcactttgggaggccgaggc

SEQ ID NO: 36581 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cccatcactttgggaggccg

SEQ ID NO: 36582 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tcccatcactttgggaggcc

SEQ ID NO: 36583 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgcaatcccatcactttggg

SEQ ID NO: 36584 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctgcaatcccatcactttgg

SEQ ID NO: 36585 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ccctgcaatcccatcacttt

SEQ ID NO: 36586 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
cccctgcaatcccatcactt

SEQ ID NO: 36587 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aatattatgtcaggcacagc

SEQ ID NO: 36588 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ataaaatattatgtcaggca

SEQ ID NO: 36589 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgataataaaatattatgtc

SEQ ID NO: 36590 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atgataataaaatattatgt

SEQ ID NO: 36591 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tgagtaaaacagggaaaaat

SEQ ID NO: 36592 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ccatgcagatgagtaaaaca

SEQ ID NO: 36593 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tccatgcagatgagtaaaac

SEQ ID NO: 36594 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atccatgcagatgagtaaaa

SEQ ID NO: 36595 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
atattcaaatccatgcagat

SEQ ID NO: 36596 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tgtagatattcaaatccatg

SEQ ID NO: 36597 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tttgaaaaaagaagtaaatg

SEQ ID NO: 36598 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
actttagaatttgaaaaaag

SEQ ID NO: 36599 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tatactttagaatttgaaaa

SEQ ID NO: 36600 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cttcttgagagtctatactt

SEQ ID NO: 36601 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aaaatatgtcatcttcttga

SEQ ID NO: 36602 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
taaaaatatgtcatcttctt

SEQ ID NO: 36603 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tggtatctgtcaacttttac

SEQ ID NO: 36604 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gggggtaatttcactggatg

SEQ ID NO: 36605 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttaactgggggtaatttcac

SEQ ID NO: 36606 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
attattattattttaactgg

SEQ ID NO: 36607 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tattattattattttaactg

SEQ ID NO: 36608 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ttattattattattttaact

SEQ ID NO: 36609 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
attattattattattttaac

SEQ ID NO: 36610 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
caagcatgagccaccgcgct

SEQ ID NO: 36611 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
agtgctgggattacaagcat

SEQ ID NO: 36612 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tcccaaagtgctgggattac

SEQ ID NO: 36613 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cctcgacctcccaaagtgct

SEQ ID NO: 36614 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gcctcgacctcccaaagtgc

SEQ ID NO: 36615 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ccgcccgcctcgacctccca

SEQ ID NO: 36616 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
atggtctcaatctcctgacc

SEQ ID NO: 36617 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tttcaccatgttagccagga

SEQ ID NO: 36618 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ggagtttcaccatgttagcc

SEQ ID NO: 36619 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cggagtttcaccatgttagc

SEQ ID NO: 36620 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gagacggagtttcaccatgt

SEQ ID NO: 36621 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttgtatttttagtagagacg

SEQ ID NO: 36622 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
ttttgtatttttagtagaga

SEQ ID NO: 36623 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
atgtttttgtatttttagta

SEQ ID NO: 36624 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
taatgtttttgtatttttag

SEQ ID NO: 36625 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ggctaatgtttttgtatttt

SEQ ID NO: 36626 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
caggcgcctaccaccgtgcc

SEQ ID NO: 36627 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ctccgagtagctgggactac

SEQ ID NO: 36628 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cctccgagtagctgggacta

SEQ ID NO: 36629 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gcctcagcctccgagtagct

SEQ ID NO: 36630 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tgcctcagcctccgagtagc

SEQ ID NO: 36631 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ctcctgcctcagcctccgag

SEQ ID NO: 36632 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
attctcctgcctcagcctcc

SEQ ID NO: 36633 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttcacaccattctcctgcct

SEQ ID NO: 36634 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cactgcaagctccgcgtcct

SEQ ID NO: 36635 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tcactgcaagctccgcgtcc

SEQ ID NO: 36636 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gcgcgatcttggctcactgc

SEQ ID NO: 36637 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ggagtgcagtggcgcgatct

SEQ ID NO: 36638 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tcgcccaggctggagtgcag

SEQ ID NO: 36639 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ctgtcgcccaggctggagtg

SEQ ID NO: 36640 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tcgctctgtcgcccaggctg

SEQ ID NO: 36641 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tctcgctctgtcgcccaggc

SEQ ID NO: 36642 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ggagtctcgctctgtcgccc

SEQ ID NO: 36643 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cggagtctcgctctgtcgcc

SEQ ID NO: 36644 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttttttatttttttgagacg

SEQ ID NO: 36645 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
tattttttatttttttgaga

SEQ ID NO: 36646 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tttttattttttattttttt

SEQ ID NO: 36647 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cctgtattatctgattttta

SEQ ID NO: 36648 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttatgtgctatatgcacacc

SEQ ID NO: 36649 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agtattaaaaacattcccat

SEQ ID NO: 36650 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agaagcatgcattaaaatat

SEQ ID NO: 36651 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agaaagataaataagattag

SEQ ID NO: 36652 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
taaagaaagataaataagat

SEQ ID NO: 36653 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gcctctaaagaaagataaat

SEQ ID NO: 36654 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gaaaattgagcctctaaaga

SEQ ID NO: 36655 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
attggaaaattgagcctcta

SEQ ID NO: 36656 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gtacaaataattggaaaatt

SEQ ID NO: 36657 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aaactattagtacaaataat

SEQ ID NO: 36658 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ccacttttaggtcaaactat

SEQ ID NO: 36659 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gcaaattttactccactttt

SEQ ID NO: 36660 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ggcaaattttactccacttt

SEQ ID NO: 36661 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gtttgatatgtacgccagta

SEQ ID NO: 36662 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgtttgatatgtacgccagt

SEQ ID NO: 36663 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
caaatgtttgatatgtacgc

SEQ ID NO: 36664 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gtgtacatttacaattaagt

SEQ ID NO: 36665 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gagtgtgtacatttacaatt

SEQ ID NO: 36666 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttcacttggaaatttagaaa

SEQ ID NO: 36667 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgttcacttggaaatttaga

SEQ ID NO: 36668 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ggattgttcacttggaaatt

SEQ ID NO: 36669 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tgcacctaggattgttcact

SEQ ID NO: 36670 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ataaagctctaattgcacct

SEQ ID NO: 36671 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aataaagctctaattgcacc

SEQ ID NO: 36672 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tcatttatcaaaatacaata

SEQ ID NO: 36673 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gtctccttggattttttaca

SEQ ID NO: 36674 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
atttctttaaaatgtctcct

SEQ ID NO: 36675 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttgttatgtcaagtgttaga

SEQ ID NO: 36676 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tcttgttatgtcaagtgtta

SEQ ID NO: 36677 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cctcttgttatgtcaagtgt

SEQ ID NO: 36678 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgatttcctcttgttatgtc

SEQ ID NO: 36679 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttttaaagtgatataacatg

SEQ ID NO: 36680 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttttttaaagtgatataaca

SEQ ID NO: 36681 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aactatctttagatttttta

SEQ ID NO: 36682 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cacaggagatgaactatctt

SEQ ID NO: 36683 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttgttgtttctttaacacag

SEQ ID NO: 36684 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgttgttgtttctttaacac

SEQ ID NO: 36685 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttgttgttgtttctttaaca

SEQ ID NO: 36686 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttaaaataacaacttactgt

SEQ ID NO: 36687 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tatatctttttagttctata

SEQ ID NO: 36688 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tctatatctttttagttcta

SEQ ID NO: 36689 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tgaattattctatatctttt

SEQ ID NO: 36690 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
caagtttgaattgacatatg

SEQ ID NO: 36691 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aagcataatctgccacagac

SEQ ID NO: 36692 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ccagtaagcataatctgcca

SEQ ID NO: 36693 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atgccttgaacagtgccagt

SEQ ID NO: 36694 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gggaatgccttgaacagtgc

SEQ ID NO: 36695 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gaagaggggaatgccttgaa

SEQ ID NO: 36696 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ataaagtggggaaggaagag

SEQ ID NO: 36697 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gataaagtggggaaggaaga

SEQ ID NO: 36698 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgataaagtggggaaggaag

SEQ ID NO: 36699 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
atgataaagtggggaaggaa

SEQ ID NO: 36700 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ccatgataaagtggggaagg

SEQ ID NO: 36701 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aggccatgataaagtgggga

SEQ ID NO: 36702 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
caggccatgataaagtgggg

SEQ ID NO: 36703 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tgccaggccatgataaagtg

SEQ ID NO: 36704 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
atgccaggccatgataaagt

SEQ ID NO: 36705 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aatgccaggccatgataaag

SEQ ID NO: 36706 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaaaatgccaggccatgata

SEQ ID NO: 36707 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gggtggtgaggaaaaatgcc

SEQ ID NO: 36708 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tgggtggtgaggaaaaatgc

SEQ ID NO: 36709 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgaaacccttctgggtggtg

SEQ ID NO: 36710 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
atgaaacccttctgggtggt

SEQ ID NO: 36711 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aggaatgaaacccttctggg

SEQ ID NO: 36712 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tggaggaatgaaacccttct

SEQ ID NO: 36713 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttggaggaatgaaacccttc

SEQ ID NO: 36714 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aaaggtggaatgaagtttgg

SEQ ID NO: 36715 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
taaaggtggaatgaagtttg

SEQ ID NO: 36716 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gctaaaggtggaatgaagtt

SEQ ID NO: 36717 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tggcagctaaaggtggaatg

SEQ ID NO: 36718 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
cagctcttggcagctaaagg

SEQ ID NO: 36719 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
catcagctcttggcagctaa

SEQ ID NO: 36720 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ccatcagctcttggcagcta

SEQ ID NO: 36721 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aaaaagccatcagctcttgg

SEQ ID NO: 36722 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aagaaaaagccatcagctct

SEQ ID NO: 36723 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
taggcaaaagaaaaagccat

SEQ ID NO: 36724 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atggctttaggcaaaagaaa

SEQ ID NO: 36725 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaggaaatggctttaggcaa

SEQ ID NO: 36726 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgctggaaggaaatggcttt

SEQ ID NO: 36727 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttgctggaaggaaatggctt

SEQ ID NO: 36728 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tctgccttgctggaaggaaa

SEQ ID NO: 36729 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ctttcctctgccttgctgga

SEQ ID NO: 36730 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cctttcctctgccttgctgg

SEQ ID NO: 36731 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
taccctttcctctgccttgc

SEQ ID NO: 36732 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aaatgaaatttcttcattga

SEQ ID NO: 36733 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaaatgaaatttcttcattg

SEQ ID NO: 36734 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ggaatatgagataacaattt

SEQ ID NO: 36735 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
agaatacttttgtggaatat

SEQ ID NO: 36736 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
atgtgggtagaatacttttg

SEQ ID NO: 36737 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gagcatccagagaatgtggg

SEQ ID NO: 36738 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tgagagcatccagagaatgt

SEQ ID NO: 36739 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
atgagagcatccagagaatg

SEQ ID NO: 36740 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aggatttatgagagcatcca

SEQ ID NO: 36741 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tgaggatttatgagagcatc

SEQ ID NO: 36742 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttttatatgaggatttatga

SEQ ID NO: 36743 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tattttatatgaggatttat

SEQ ID NO: 36744 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gtataaaaatattttatatg

SEQ ID NO: 36745 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tgtataaaaatattttatat

SEQ ID NO: 36746 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gaggcaaggtcatattaaaa

SEQ ID NO: 36747 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
agattaccacttgagaggca

SEQ ID NO: 36748 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tagattaccacttgagaggc

SEQ ID NO: 36749 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gagttagattaccacttgag

SEQ ID NO: 36750 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
agagttagattaccacttga

SEQ ID NO: 36751 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gtagagttagattaccactt

SEQ ID NO: 36752 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cctttagaactgtgtagagt

SEQ ID NO: 36753 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tcttcctttagaactgtgta

SEQ ID NO: 36754 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
catcttcctttagaactgtg

SEQ ID NO: 36755 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
agtattatgacatcttcctt

SEQ ID NO: 36756 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agctaatttattctttacag

SEQ ID NO: 36757 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
attagctaatttattcttta

SEQ ID NO: 36758 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tcatattacacatcacaaat

SEQ ID NO: 36759 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
atctgtgtactaattgaaga

SEQ ID NO: 36760 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gggcatctgtgtactaattg

SEQ ID NO: 36761 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
attgtggatgttgtattgga

SEQ ID NO: 36762 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tattgtggatgttgtattgg

SEQ ID NO: 36763 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
atattgtggatgttgtattg

SEQ ID NO: 36764 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
acatattgtggatgttgtat

SEQ ID NO: 36765 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gctctgaagaggacatattg

SEQ ID NO: 36766 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tttaaaaatttgctctgaag

SEQ ID NO: 36767 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttttaaaaatttgctctgaa

SEQ ID NO: 36768 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atttttaaaaatttgctctg

SEQ ID NO: 36769 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tatttcactaattgtgagca

SEQ ID NO: 36770 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttatttcactaattgtgagc

SEQ ID NO: 36771 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
attatttcactaattgtgag

SEQ ID NO: 36772 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
taaattatttcactaattgt

SEQ ID NO: 36773 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gttaccacattacatcttga

SEQ ID NO: 36774 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ggttaccacattacatcttg

SEQ ID NO: 36775 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
cagatttttggtaaataatt

SEQ ID NO: 36776 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aatggccagccacagatttt

SEQ ID NO: 36777 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atgtagcaaatggccagcca

SEQ ID NO: 36778 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttttttatgtagcaaatggc

SEQ ID NO: 36779 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tgatttttttatgtagcaaa

SEQ ID NO: 36780 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tgattaatgatttttttatg

SEQ ID NO: 36781 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgaaaatttagctttcaatt

SEQ ID NO: 36782 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttgaaaatttagctttcaat

SEQ ID NO: 36783 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttaacatttggttgaaaatt

SEQ ID NO: 36784 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ctagttttgctattaacatt

SEQ ID NO: 36785 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aaagatattaaacaaacaac

SEQ ID NO: 36786 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atttttgcagactatgctta

SEQ ID NO: 36787 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gcctcccccctttatttttg

SEQ ID NO: 36788 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
acacacacacacactttgta

SEQ ID NO: 36789 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tgattgtgtcattttcatac

SEQ ID NO: 36790 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ctgttattagagtggaagta

SEQ ID NO: 36791 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
actgttattagagtggaagt

SEQ ID NO: 36792 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
catcactgttattagagtgg

SEQ ID NO: 36793 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
acccatcactgttattagag

SEQ ID NO: 36794 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aagacccatcactgttatta

SEQ ID NO: 36795 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tgaagacccatcactgttat

SEQ ID NO: 36796 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gcaatgtgggcttatccatg

SEQ ID NO: 36797 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aaggttcagagaggcaatgt

SEQ ID NO: 36798 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gaaggttcagagaggcaatg

SEQ ID NO: 36799 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tctctaaggaaggttcagag

SEQ ID NO: 36800 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttctctaaggaaggttcaga

SEQ ID NO: 36801 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cattctctaaggaaggttca

SEQ ID NO: 36802 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
agcattctctaaggaaggtt

SEQ ID NO: 36803 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tttgaagcattctctaagga

SEQ ID NO: 36804 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atttgaagcattctctaagg

SEQ ID NO: 36805 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aatatttgaagcattctcta

SEQ ID NO: 36806 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaatatttgaagcattctct

SEQ ID NO: 36807 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gcacattatccaaatatttg

SEQ ID NO: 36808 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
atgtttgccccaggtacaaa

SEQ ID NO: 36809 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gatgtttgccccaggtacaa

SEQ ID NO: 36810 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgatgtttgccccaggtaca

SEQ ID NO: 36811 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tctaaattgatgtttgcccc

SEQ ID NO: 36812 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gtctaaattgatgtttgccc

SEQ ID NO: 36813 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
ccataagttaggtttccaca

SEQ ID NO: 36814 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgaggcggaggccataagtt

SEQ ID NO: 36815 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
atgaggcggaggccataagt

SEQ ID NO: 36816 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tcagatgaggcggaggccat

SEQ ID NO: 36817 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aatgtagtcagatgaggcgg

SEQ ID NO: 36818 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aaatgtagtcagatgaggcg

SEQ ID NO: 36819 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
agaaatgtagtcagatgagg

SEQ ID NO: 36820 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gatagaaatgtagtcagatg

SEQ ID NO: 36821 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tgatagaaatgtagtcagat

SEQ ID NO: 36822 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tcagttgatagaaatgtagt

SEQ ID NO: 36823 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gagctcagttgatagaaatg

SEQ ID NO: 36824 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gcttatgtgagctcagttga

SEQ ID NO: 36825 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
catagatgcttatgtgagct

SEQ ID NO: 36826 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ataaacatagatgcttatgt

SEQ ID NO: 36827 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
atattcttttaaaataaaca

SEQ ID NO: 36828 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gaaatttgagggccagtcaa

SEQ ID NO: 36829 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tctaacagaaatttgagggc

SEQ ID NO: 36830 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
atcatctaacagaaatttga

SEQ ID NO: 36831 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tatcatctaacagaaatttg

SEQ ID NO: 36832 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gtatcatctaacagaaattt

SEQ ID NO: 36833 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tttaaatctgtatcatctaa

SEQ ID NO: 36834 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tctaaaatgataaccttgtt

SEQ ID NO: 36835 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
atctaaaatgataaccttgt

SEQ ID NO: 36836 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gcataaactaatatggttat

SEQ ID NO: 36837 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttggattgcataaactaata

SEQ ID NO: 36838 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aatatattttaagaaaaaat

SEQ ID NO: 36839 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aatgtattaaaatatatttt

SEQ ID NO: 36840 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gtaatgcattcttagaaagg

SEQ ID NO: 36841 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tttgtaatgcattcttagaa

SEQ ID NO: 36842 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atttgtaatgcattcttaga

SEQ ID NO: 36843 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
agtaatttgtaatgcattct

SEQ ID NO: 36844 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gtgataatgtacttaaaggt

SEQ ID NO: 36845 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gtaggtgataatgtacttaa

SEQ ID NO: 36846 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgtaggtgataatgtactta

SEQ ID NO: 36847 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
attctctcttttatcagtgt

SEQ ID NO: 36848 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tattctctcttttatcagtg

SEQ ID NO: 36849 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
agatgtattctctcttttat

SEQ ID NO: 36850 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aggtaaaattaaaatatcct

SEQ ID NO: 36851 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
atcatggtatgatattgagg

SEQ ID NO: 36852 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tatcatggtatgatattgag

SEQ ID NO: 36853 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aatatcatggtatgatattg

SEQ ID NO: 36854 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
caatatcatggtatgatatt

SEQ ID NO: 36855 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttagtatttttacaatatca

SEQ ID NO: 36856 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttttttatttgtcaagcatt

SEQ ID NO: 36857 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gattctattttttatttgtc

SEQ ID NO: 36858 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agaataaagcatattaaccc

SEQ ID NO: 36859 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atatggattcttccagaata

SEQ ID NO: 36860 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tacaaaaatatggattcttc

SEQ ID NO: 36861 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aataataaaatacaaaaata

SEQ ID NO: 36862 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
atcaagtagtagggggttcg

SEQ ID NO: 36863 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gcctggcatcaagtagtagg

SEQ ID NO: 36864 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tgcctggcatcaagtagtag

SEQ ID NO: 36865 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gtgcctggcatcaagtagta

SEQ ID NO: 36866 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
agtgcctggcatcaagtagt

SEQ ID NO: 36867 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tagtgcctggcatcaagtag

SEQ ID NO: 36868 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gaatagtgcctggcatcaag

SEQ ID NO: 36869 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ccagaatagtgcctggcatc

SEQ ID NO: 36870 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttagcttccagaatagtgcc

SEQ ID NO: 36871 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tgttgacttagcttccagaa

SEQ ID NO: 36872 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttcattgttgacttagcttc

SEQ ID NO: 36873 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ctatgtcttcattgttgact

SEQ ID NO: 36874 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ccaaatactccaagggaacc

SEQ ID NO: 36875 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ttgcataccaaatactccaa

SEQ ID NO: 36876 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tttgcataccaaatactcca

SEQ ID NO: 36877 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atttgcataccaaatactcc

SEQ ID NO: 36878 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tactgcttgttacagcatgc

SEQ ID NO: 36879 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atactgcttgttacagcatg

SEQ ID NO: 36880 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttctttcatactgcttgtta

SEQ ID NO: 36881 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tcccgtgttggtcttgatgt

SEQ ID NO: 36882 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aaaagtaggttgtcccgtgt

SEQ ID NO: 36883 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttgatcatcttgttaaaagt

SEQ ID NO: 36884 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tttgatcatcttgttaaaag

SEQ ID NO: 36885 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atttttgatcatcttgttaa

SEQ ID NO: 36886 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cgaggtttttttgttttgga

SEQ ID NO: 36887 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aactcgaggtttttttgttt

SEQ ID NO: 36888 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aaactttaaatctcaactcg

SEQ ID NO: 36889 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
taaactttaaatctcaactc

SEQ ID NO: 36890 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgaaacaatagcactcttta

SEQ ID NO: 36891 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atgaaacaatagcactcttt

SEQ ID NO: 36892 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ggctaaaacacatgaaacaa

SEQ ID NO: 36893 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aggtgctcctgcccaggtcg

SEQ ID NO: 36894 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tcattaaggtgctcctgccc

SEQ ID NO: 36895 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ctcattaaggtgctcctgcc

SEQ ID NO: 36896 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aacctattctcttctcatta

SEQ ID NO: 36897 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gaacctattctcttctcatt

SEQ ID NO: 36898 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tcccttctctccaacctcac

SEQ ID NO: 36899 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aaatgcctttcctcagcata

SEQ ID NO: 36900 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
caacagtaaatgcctttcct

SEQ ID NO: 36901 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cagagaccaattagcaacaa

SEQ ID NO: 36902 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
atggcaacacagagaccaat

SEQ ID NO: 36903 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gaaataaacatggcaacaca

SEQ ID NO: 36904 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aagaaataaacatggcaaca

SEQ ID NO: 36905 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aggagaagaagaaataaaca

SEQ ID NO: 36906 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aggaagaagaagaggagaag

SEQ ID NO: 36907 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aagaggaagaagaagaggag

SEQ ID NO: 36908 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aaaaagaggaagaagaagag

SEQ ID NO: 36909 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aaaaaaagaggaagaagaag

SEQ ID NO: 36910 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aaaaaaaagaggaagaagaa

SEQ ID NO: 36911 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaaaaaaaaagaggaagaag

SEQ ID NO: 36912 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaaaaaaaaaaaagaggaag

SEQ ID NO: 36913 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
taaaaaaaaaaaaaaagagg

SEQ ID NO: 36914 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
atttaaaaaaaaaaaaaaag

SEQ ID NO: 36915 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
catttaaaaaaaaaaaaaaa

SEQ ID NO: 36916 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgcatttaaaaaaaaaaaaa

SEQ ID NO: 36917 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ctgtctcccctaacaaacat

SEQ ID NO: 36918 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgcaattcattctctataca

SEQ ID NO: 36919 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atttacttggaatcctgcca

SEQ ID NO: 36920 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ggtcatcatcataatttact

SEQ ID NO: 36921 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cacggccaccaaattagttc

SEQ ID NO: 36922 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
acacggccaccaaattagtt

SEQ ID NO: 36923 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tatctacacggccaccaaat

SEQ ID NO: 36924 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
ccctcttttctgtatctaca

SEQ ID NO: 36925 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttctatttcatcatacgtct

SEQ ID NO: 36926 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
agccctttccagcctgtaag

SEQ ID NO: 36927 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttcagccctttccagcctgt

SEQ ID NO: 36928 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tactccatttcagccctttc

SEQ ID NO: 36929 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tcttccttattactccattt

SEQ ID NO: 36930 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aataaatgccttcaccatcc

SEQ ID NO: 36931 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ctttccctaaaactctgtct

SEQ ID NO: 36932 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttgatgtaaatggaacattc

SEQ ID NO: 36933 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttaaagtttattgatgtaaa

SEQ ID NO: 36934 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgatcttgtaaaagagctta

SEQ ID NO: 36935 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
caagtcatgatcttgtaaaa

SEQ ID NO: 36936 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gacaagtcatgatcttgtaa

SEQ ID NO: 36937 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atatggtacttttctaagac

SEQ ID NO: 36938 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gatttatatggtacttttct

SEQ ID NO: 36939 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aagtgctagaaggatttata

SEQ ID NO: 36940 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aaagagtgtgaagtgctaga

SEQ ID NO: 36941 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaaagagtgtgaagtgctag

SEQ ID NO: 36942 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tgcaaaagagtgtgaagtgc

SEQ ID NO: 36943 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tagttatgcaaaagagtgtg

SEQ ID NO: 36944 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttcctattagttatgcaaaa

SEQ ID NO: 36945 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tattcctattagttatgcaa

SEQ ID NO: 36946 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tatccaatttctattcctat

SEQ ID NO: 36947 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ctctgtggcaaggaaaaaag

SEQ ID NO: 36948 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tttctctgtggcaaggaaaa

SEQ ID NO: 36949 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aacccactttctctgtggca

SEQ ID NO: 36950 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
caacccactttctctgtggc

SEQ ID NO: 36951 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
taatcaacccactttctctg

SEQ ID NO: 36952 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
attcagaagagcaatcagta

SEQ ID NO: 36953 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aattcagaagagcaatcagt

SEQ ID NO: 36954 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aaattcagaagagcaatcag

SEQ ID NO: 36955 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aataaattcagaagagcaat

SEQ ID NO: 36956 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
acaaataaataaattcagaa

SEQ ID NO: 36957 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaacaaataaataaattcag

SEQ ID NO: 36958 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gataaacaaataaataaatt

SEQ ID NO: 36959 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gctgagtttcagaagcaaaa

SEQ ID NO: 36960 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gttgctgtgctgagtttcag

SEQ ID NO: 36961 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cctgttgctgtgctgagttt

SEQ ID NO: 36962 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttactacctgttgctgtgct

SEQ ID NO: 36963 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
taatcatgggagcccttctg

SEQ ID NO: 36964 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gggcctgcatataatcatgg

SEQ ID NO: 36965 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tagggcctgcatataatcat

SEQ ID NO: 36966 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ctagggcctgcatataatca

SEQ ID NO: 36967 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cttgggcctcctttccccta

SEQ ID NO: 36968 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tcttgggcctcctttcccct

SEQ ID NO: 36969 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
atcttgggcctcctttcccc

SEQ ID NO: 36970 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ctctctgccaaaagcatctt

SEQ ID NO: 36971 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gctctctgccaaaagcatct

SEQ ID NO: 36972 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
caggtctggctctctgccaa

SEQ ID NO: 36973 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gaagaaagatgagtcaggtc

SEQ ID NO: 36974 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ctacagaagaaagatgagtc

SEQ ID NO: 36975 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tctacagaagaaagatgagt

SEQ ID NO: 36976 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tgcttctacagaagaaagat

SEQ ID NO: 36977 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cctgatgcttctacagaaga

SEQ ID NO: 36978 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agtacctgatgcttctacag

SEQ ID NO: 36979 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cagagtacctgatgcttcta

SEQ ID NO: 36980 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ggtgcagggctaggctcaca

SEQ ID NO: 36981 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atggtgcagggctaggctca

SEQ ID NO: 36982 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gattcctatggtgcagggct

SEQ ID NO: 36983 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tgattcctatggtgcagggc

SEQ ID NO: 36984 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gccttgattcctatggtgca

SEQ ID NO: 36985 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgccttgattcctatggtgc

SEQ ID NO: 36986 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atgccttgattcctatggtg

SEQ ID NO: 36987 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
atgatatgccttgattccta

SEQ ID NO: 36988 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tgatgtgtttttacagtgac

SEQ ID NO: 36989 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gactcagtgatgtgttttta

SEQ ID NO: 36990 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cactgtgcagttgtgggact

SEQ ID NO: 36991 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gtaagccactgtgcagttgt

SEQ ID NO: 36992 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agtaagccactgtgcagttg

SEQ ID NO: 36993 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tccttaagtaagccactgtg

SEQ ID NO: 36994 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaaaggaggtttccttaagt

SEQ ID NO: 36995 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gtttaaaaggaggtttcctt

SEQ ID NO: 36996 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttttgtagaggtttaaaagg

SEQ ID NO: 36997 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
attttgtagaggtttaaaag

SEQ ID NO: 36998 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aaattttgtagaggtttaaa

SEQ ID NO: 36999 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaaattttgtagaggtttaa

SEQ ID NO: 37000 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
agttttttaaaattttgtag

SEQ ID NO: 37001 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aagttttttaaaattttgta

SEQ ID NO: 37002 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
acaagttttttaaaattttg

SEQ ID NO: 37003 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ctgatagtttggcttaagac

SEQ ID NO: 37004 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ggcaactgatagtttggctt

SEQ ID NO: 37005 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tatttaggcaactgatagtt

SEQ ID NO: 37006 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ccctctatttaggcaactga

SEQ ID NO: 37007 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gaagaatgtgccctctattt

SEQ ID NO: 37008 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
agaagaatgtgccctctatt

SEQ ID NO: 37009 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atatggtatttgatgtaaag

SEQ ID NO: 37010 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agaatatggtatttgatgta

SEQ ID NO: 37011 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
acaaaactctagacagaata

SEQ ID NO: 37012 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atcaacaacaaaactctaga

SEQ ID NO: 37013 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gcttatcaacaacaaaactc

SEQ ID NO: 37014 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aattttcatgattgttagac

SEQ ID NO: 37015 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tcgcaaattttcatgattgt

SEQ ID NO: 37016 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttattgattagtttgaaagc

SEQ ID NO: 37017 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaaattattgattagtttga

SEQ ID NO: 37018 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
attttttaaaaattattgat

SEQ ID NO: 37019 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttttttcttataattatggt

SEQ ID NO: 37020 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ataattttttcttataatta

SEQ ID NO: 37021 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
attttttccactatttaaaa

SEQ ID NO: 37022 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tcattttattgcaaattctt

SEQ ID NO: 37023 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tcttccctgtagacaagata

SEQ ID NO: 37024 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atttcttcttccctgtagac

SEQ ID NO: 37025 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tttctatttcttcttccctg

SEQ ID NO: 37026 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttgggaagttcagttctttt

SEQ ID NO: 37027 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gaagtcagtgttgggaagtt

SEQ ID NO: 37028 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aataggaagtcagtgttggg

SEQ ID NO: 37029 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ctgaataggaagtcagtgtt

SEQ ID NO: 37030 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
actgaataggaagtcagtgt

SEQ ID NO: 37031 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tcagttactgaataggaagt

SEQ ID NO: 37032 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cttgtcagttactgaatagg

SEQ ID NO: 37033 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tagcttgtcagttactgaat

SEQ ID NO: 37034 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
atagcttgtcagttactgaa

SEQ ID NO: 37035 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tcaaggaagtgatagcttgt

SEQ ID NO: 37036 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gtaagctttcaaggaagtga

SEQ ID NO: 37037 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atcaaagtaagctttcaagg

SEQ ID NO: 37038 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
caaatcaaagtaagctttca

SEQ ID NO: 37039 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ccaaatcaaagtaagctttc

SEQ ID NO: 37040 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gataaaagccaaatcaaagt

SEQ ID NO: 37041 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gtaagataaaagccaaatca

SEQ ID NO: 37042 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agctagtgtcagtaagataa

SEQ ID NO: 37043 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tttaagaagctagtgtcagt

SEQ ID NO: 37044 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ggtttttaagaagctagtgt

SEQ ID NO: 37045 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
taggggggtttttaagaagc

SEQ ID NO: 37046 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aacttaggggggtttttaag

SEQ ID NO: 37047 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agaaacttaggggggttttt

SEQ ID NO: 37048 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tttacatgagaaacttaggg

SEQ ID NO: 37049 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
atttacatgagaaacttagg

SEQ ID NO: 37050 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aatttacatgagaaacttag

SEQ ID NO: 37051 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
caatttacatgagaaactta

SEQ ID NO: 37052 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gcaatttacatgagaaactt

SEQ ID NO: 37053 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
agcaatttacatgagaaact

SEQ ID NO: 37054 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
atgttaagagcaatttacat

SEQ ID NO: 37055 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tatatctactctgatgttaa

SEQ ID NO: 37056 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
attatatctactctgatgtt

SEQ ID NO: 37057 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tttttaagttggagcgttca

SEQ ID NO: 37058 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
agttttttttttttaagttg

SEQ ID NO: 37059 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttagttttttttttttaagt

SEQ ID NO: 37060 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tattttagtttttttttttt

SEQ ID NO: 37061 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aaacatttcactcattattt

SEQ ID NO: 37062 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aatgccagtttttgtgatta

SEQ ID NO: 37063 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gaaactagaaacattaatgc

SEQ ID NO: 37064 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
caaaaatcagaacaagaaac

SEQ ID NO: 37065 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttcaagacaaaaatcagaac

SEQ ID NO: 37066 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cttatattcaagacaaaaat

SEQ ID NO: 37067 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tattttcgtgccttatattc

SEQ ID NO: 37068 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
catttacttttaggaaaaaa

SEQ ID NO: 37069 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgggaaactcatttactttt

SEQ ID NO: 37070 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttgggaaactcatttacttt

SEQ ID NO: 37071 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ctttttatcgaattcaactt

SEQ ID NO: 37072 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
actttttatcgaattcaact

SEQ ID NO: 37073 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
agtgaaattcagaaaagatg

SEQ ID NO: 37074 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ctttatagtgaaattcagaa

SEQ ID NO: 37075 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aagcactttatagtgaaatt

SEQ ID NO: 37076 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tttttcgaataagcacttta

SEQ ID NO: 37077 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atttatttattttttcgaat

SEQ ID NO: 37078 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tctgcccctatttctcagcg

SEQ ID NO: 37079 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
acagctctgcccctatttct

SEQ ID NO: 37080 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aacacaaataattgacagga

SEQ ID NO: 37081 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cacaaacacaaataattgac

SEQ ID NO: 37082 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
acacaaacacaaataattga

SEQ ID NO: 37083 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aagaaccccgcaccccttaa

SEQ ID NO: 37084 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaaagaaccccgcacccctt

SEQ ID NO: 37085 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tacaacctgtggggacagaa

SEQ ID NO: 37086 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gcagatacaacctgtgggga

SEQ ID NO: 37087 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cttagcagatacaacctgtg

SEQ ID NO: 37088 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gcttagcagatacaacctgt

SEQ ID NO: 37089 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agcttagcagatacaacctg

SEQ ID NO: 37090 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
agcgtgcagaaccagcttag

SEQ ID NO: 37091 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ctgagcgtgcagaaccagct

SEQ ID NO: 37092 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
caaagctgagcgtgcagaac

SEQ ID NO: 37093 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
catctgcaaagctgagcgtg

SEQ ID NO: 37094 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tatttcccatctgcaaagct

SEQ ID NO: 37095 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgctgtatttcccatctgca

SEQ ID NO: 37096 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tcacattttttacgagcaaa

SEQ ID NO: 37097 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gggcagctcacattttttac

SEQ ID NO: 37098 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atggacttcaattcaagggg

SEQ ID NO: 37099 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tagatggacttcaattcaag

SEQ ID NO: 37100 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ttagatggacttcaattcaa

SEQ ID NO: 37101 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gttagatggacttcaattca

SEQ ID NO: 37102 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgttagatggacttcaattc

SEQ ID NO: 37103 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
acgctagcagagttgttaga

SEQ ID NO: 37104 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gtttacgctagcagagttgt

SEQ ID NO: 37105 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tatttctgtttacgctagca

SEQ ID NO: 37106 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tttatttctgtttacgctag

SEQ ID NO: 37107 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tcttttatttctgtttacgc

SEQ ID NO: 37108 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ggaagggtagcaatgcctgg

SEQ ID NO: 37109 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aaaggaagggtagcaatgcc

SEQ ID NO: 37110 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gaaactgtggaaaggaaggg

SEQ ID NO: 37111 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tctgaaactgtggaaaggaa

SEQ ID NO: 37112 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttctgaaactgtggaaagga

SEQ ID NO: 37113 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gttctgaaactgtggaaagg

SEQ ID NO: 37114 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
caggttctgaaactgtggaa

SEQ ID NO: 37115 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ccaggttctgaaactgtgga

SEQ ID NO: 37116 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gctgccaggttctgaaactg

SEQ ID NO: 37117 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gactctgtgggtttgctgcc

SEQ ID NO: 37118 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tgactctgtgggtttgctgc

SEQ ID NO: 37119 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ctgtgcggttttgactctgt

SEQ ID NO: 37120 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
cctgtgcggttttgactctg

SEQ ID NO: 37121 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
atagctgggcagctcctgtg

SEQ ID NO: 37122 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tagttatttcgatagctggg

SEQ ID NO: 37123 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gcgtagttatttcgatagct

SEQ ID NO: 37124 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agcgtagttatttcgatagc

SEQ ID NO: 37125 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tggaagcgtagttatttcga

SEQ ID NO: 37126 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aggaagaagggctggaagcg

SEQ ID NO: 37127 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atgggaggaagaagggctgg

SEQ ID NO: 37128 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gcaatgggaggaagaagggc

SEQ ID NO: 37129 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tccagcaatgggaggaagaa

SEQ ID NO: 37130 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttccagcaatgggaggaaga

SEQ ID NO: 37131 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gttccagcaatgggaggaag

SEQ ID NO: 37132 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gtggttccagcaatgggagg

SEQ ID NO: 37133 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cgggtggttccagcaatggg

SEQ ID NO: 37134 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ccgggtggttccagcaatgg

SEQ ID NO: 37135 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gaccgggtggttccagcaat

SEQ ID NO: 37136 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tgaccgggtggttccagcaa

SEQ ID NO: 37137 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gaagcttgaccgggtggttc

SEQ ID NO: 37138 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aggggagaagcttgaccggg

SEQ ID NO: 37139 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gagaggggagaagcttgacc

SEQ ID NO: 37140 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
agagaggggagaagcttgac

SEQ ID NO: 37141 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ctggaaagaagagaggggag

SEQ ID NO: 37142 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cacctggaaagaagagaggg

SEQ ID NO: 37143 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gccacctggaaagaagagag

SEQ ID NO: 37144 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cgccacctggaaagaagaga

SEQ ID NO: 37145 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
acgccacctggaaagaagag

SEQ ID NO: 37146 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tacgccacctggaaagaaga

SEQ ID NO: 37147 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
attacgccacctggaaagaa

SEQ ID NO: 37148 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gtattacgccacctggaaag

SEQ ID NO: 37149 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cctgtattacgccacctgga

SEQ ID NO: 37150 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gaaccctgtattacgccacc

SEQ ID NO: 37151 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ctattttcacatctcggttc

SEQ ID NO: 37152 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
ctgtgtctattttcacatct

SEQ ID NO: 37153 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
gggaggggaggagaagccct

SEQ ID NO: 37154 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttctgtggggaggggaggag

SEQ ID NO: 37155 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tgcttctgtggggaggggag

SEQ ID NO: 37156 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gctgcttctgtggggagggg

SEQ ID NO: 37157 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tgctgcttctgtggggaggg

SEQ ID NO: 37158 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tttgctgcttctgtggggag

SEQ ID NO: 37159 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ttttgctgcttctgtgggga

SEQ ID NO: 37160 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cttttgctgcttctgtgggg

SEQ ID NO: 37161 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tcttttgctgcttctgtggg

SEQ ID NO: 37162 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tttcttttgctgcttctgtg

SEQ ID NO: 37163 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ttttcttttgctgcttctgt

SEQ ID NO: 37164 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
cttttcttttgctgcttctg

SEQ ID NO: 37165 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cggcgggctaggttgcaagt

SEQ ID NO: 37166 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgatcggcgggctaggttgc

SEQ ID NO: 37167 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gtggggatgatcggcgggct

SEQ ID NO: 37168 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ggtggggatgatcggcgggc

SEQ ID NO: 37169 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
actgggtggggatgatcggc

SEQ ID NO: 37170 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
cactgggtggggatgatcgg

SEQ ID NO: 37171 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
gtgcactgggtggggatgat

SEQ ID NO: 37172 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ttctgcaggtgcactgggtg

SEQ ID NO: 37173 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
attctgcaggtgcactgggt

SEQ ID NO: 37174 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gattctgcaggtgcactggg

SEQ ID NO: 37175 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ccagattctgcaggtgcact

SEQ ID NO: 37176 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gccagattctgcaggtgcac

SEQ ID NO: 37177 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ctcctggagccagattctgc

SEQ ID NO: 37178 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tctcctggagccagattctg

SEQ ID NO: 37179 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cccgcgccctctcctggagc

SEQ ID NO: 37180 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gaggcccgcgccctctcctg

SEQ ID NO: 37181 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gagaggcccgcgccctctcc

SEQ ID NO: 37182 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
agagagcgccggggaaggag

SEQ ID NO: 37183 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gagagagcgccggggaagga

SEQ ID NO: 37184 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctgagagagcgccggggaag

SEQ ID NO: 37185 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ccctgagagagcgccgggga

SEQ ID NO: 37186 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gccctgagagagcgccgggg

SEQ ID NO: 37187 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gcagccctgagagagcgccg

SEQ ID NO: 37188 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
agcagccctgagagagcgcc

SEQ ID NO: 37189 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
aagcagccctgagagagcgc

SEQ ID NO: 37190 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aaaaagaagcagccctgaga

SEQ ID NO: 37191 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
agaaaaagaagcagccctga

SEQ ID NO: 37192 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
agagaaaaagaagcagccct

SEQ ID NO: 37193 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ggagcccagagaaaaagaag

SEQ ID NO: 37194 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
acaggagcccagagaaaaag

SEQ ID NO: 37195 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gcaacaggagcccagagaaa

SEQ ID NO: 37196 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ccctgagcaacaggagccca

SEQ ID NO: 37197 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tcccctgagcaacaggagcc

SEQ ID NO: 37198 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aggcgtcccctgagcaacag

SEQ ID NO: 37199 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gcaggcgtcccctgagcaac

SEQ ID NO: 37200 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ggcaggcgtcccctgagcaa

SEQ ID NO: 37201 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gctagcggcaggcgtcccct

SEQ ID NO: 37202 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgccagtggctgctagcggc

SEQ ID NO: 37203 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gtgccagtggctgctagcgg

SEQ ID NO: 37204 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
tgggtgccagtggctgctag

SEQ ID NO: 37205 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gcctgggtgccagtggctgc

SEQ ID NO: 37206 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tgggctagcctgggtgccag

SEQ ID NO: 37207 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ggctgggctagcctgggtgc

SEQ ID NO: 37208 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ggctgaggctgggctagcct

SEQ ID NO: 37209 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
cggctgaggctgggctagcc

SEQ ID NO: 37210 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cagctcggctgaggctgggc

SEQ ID NO: 37211 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ccgccagctcggctgaggct

SEQ ID NO: 37212 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tccgccagctcggctgaggc

SEQ ID NO: 37213 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
caattccgccagctcggctg

SEQ ID NO: 37214 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ccaattccgccagctcggct

SEQ ID NO: 37215 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
gctttccaattccgccagct

SEQ ID NO: 37216 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tgtcggctttccaattccgc

SEQ ID NO: 37217 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
agcgctccagcggcggctgt

SEQ ID NO: 37218 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
ggtcgccagcgctccagcgg

SEQ ID NO: 37219 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
ggcggtcgccagcgctccag

SEQ ID NO: 37220 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gcaggcggtcgccagcgctc

SEQ ID NO: 37221 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gtctgcttgcaggcggtcgc

SEQ ID NO: 37222 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
gggcgcagtctgcttgcagg

SEQ ID NO: 37223 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gaggggcgcagtctgcttgc

SEQ ID NO: 37224 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ggaggggcgcagtctgcttg

SEQ ID NO: 37225 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gcgccctggcaggaggggcg

SEQ ID NO: 37226 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cgggcgcgccctggcaggag

SEQ ID NO: 37227 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
acgggcgcgccctggcagga

SEQ ID NO: 37228 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cacgggcgcgccctggcagg

SEQ ID NO: 37229 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ccacgggcgcgccctggcag

SEQ ID NO: 37230 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ctccacgggcgcgccctggc

SEQ ID NO: 37231 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cctccacgggcgcgccctgg

SEQ ID NO: 37232 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ctacctccacgggcgcgccc

SEQ ID NO: 37233 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ggcggggctgctacctccac

SEQ ID NO: 37234 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
aggcggggctgctacctcca

SEQ ID NO: 37235 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cagctgccctcggggaggcg

SEQ ID NO: 37236 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gcagctgccctcggggaggc

SEQ ID NO: 37237 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
cgcagctgccctcggggagg

SEQ ID NO: 37238 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cggcgcagctgccctcgggg

SEQ ID NO: 37239 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gcggcgcagctgccctcggg

SEQ ID NO: 37240 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aagcggcgcagctgccctcg

SEQ ID NO: 37241 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aaagcggcgcagctgccctc

SEQ ID NO: 37242 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
caaagcggcgcagctgccct

SEQ ID NO: 37243 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gtggaggaggcaaagcggcg

SEQ ID NO: 37244 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
gaggagtggaggaggcaaag

SEQ ID NO: 37245 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgggaggagtggaggaggca

SEQ ID NO: 37246 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cgcgctgggaggagtggagg

SEQ ID NO: 37247 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gcgcgctgggaggagtggag

SEQ ID NO: 37248 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gggcgcgctgggaggagtgg

SEQ ID NO: 37249 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cgggcgcgctgggaggagtg

SEQ ID NO: 37250 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
cccgggcgcgctgggaggag

SEQ ID NO: 37251 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ggacccgggcgcgctgggag

SEQ ID NO: 37252 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ggggacccgggcgcgctggg

SEQ ID NO: 37253 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tggggacccgggcgcgctgg

SEQ ID NO: 37254 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ggtggggacccgggcgcgct

SEQ ID NO: 37255 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gggtggggacccgggcgcgc

SEQ ID NO: 37256 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ggagcaaggggtggggaccc

SEQ ID NO: 37257 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
gggagcaaggggtggggacc

SEQ ID NO: 37258 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gagggagggagcaaggggtg

SEQ ID NO: 37259 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ggagggagggagcaaggggt

SEQ ID NO: 37260 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gggagggagggagcaagggg

SEQ ID NO: 37261 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ggagggagggagggagcaag

SEQ ID NO: 37262 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gggagggagggagggagcaa

SEQ ID NO: 37263 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
agggagggagggagggagca

SEQ ID NO: 37264 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gagggagggagggagggagc

SEQ ID NO: 37265 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gagagagggagggagggagg

SEQ ID NO: 37266 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tggagagagggagggaggga

SEQ ID NO: 37267 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gtggagagagggagggaggg

SEQ ID NO: 37268 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
agtggagagagggagggagg

SEQ ID NO: 37269 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ggagtggagagagggaggga

SEQ ID NO: 37270 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aggagtggagagagggaggg

SEQ ID NO: 37271 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
caggagtggagagagggagg

SEQ ID NO: 37272 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cgcaggagtggagagaggga

SEQ ID NO: 37273 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ccgcaggagtggagagaggg

SEQ ID NO: 37274 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cccgcaggagtggagagagg

SEQ ID NO: 37275 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cgcccgcaggagtggagaga

SEQ ID NO: 37276 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ccgcccgcaggagtggagag

SEQ ID NO: 37277 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gccgcccgcaggagtggaga

SEQ ID NO: 37278 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gcgccgcccgcaggagtgga

SEQ ID NO: 37279 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ctgcgccgcccgcaggagtg

SEQ ID NO: 37280 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ccctgcgccgcccgcaggag

SEQ ID NO: 37281 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ccgccctgcgccgcccgcag

SEQ ID NO: 37282 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ccccgccctgcgccgcccgc

SEQ ID NO: 37283 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tccccgccctgcgccgcccg

SEQ ID NO: 37284 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ccaccaccgcgcccctagct

SEQ ID NO: 37285 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gccaccaccgcgcccctagc

SEQ ID NO: 37286 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cgtcgccaccaccgcgcccc

SEQ ID NO: 37287 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
agcgcatggtgcagaggcta

SEQ ID NO: 37288 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tctattagcgcatggtgcag

SEQ ID NO: 37289 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttctattagcgcatggtgca

SEQ ID NO: 37290 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ccttctattagcgcatggtg

SEQ ID NO: 37291 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ctccgccttctattagcgca

SEQ ID NO: 37292 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ccccctcctccgccttctat

SEQ ID NO: 37293 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aatgggtggccgtggatggc

SEQ ID NO: 37294 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
caatgggtggccgtggatgg

SEQ ID NO: 37295 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
acccaatgggtggccgtgga

SEQ ID NO: 37296 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ccccacccaatgggtggccg

SEQ ID NO: 37297 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
cacacgccccacccaatggg

SEQ ID NO: 37298 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
acacacacgccccacccaat

SEQ ID NO: 37299 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
cacacacacgccccacccaa

SEQ ID NO: 37300 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ggaagggctcttctggctgc

SEQ ID NO: 37301 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agataagggaagggctcttc

SEQ ID NO: 37302 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gcgggggtgagataagggaa

SEQ ID NO: 37303 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ggcgggggtgagataaggga

SEQ ID NO: 37304 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gggcgggggtgagataaggg

SEQ ID NO: 37305 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tgggggcgggggtgagataa

SEQ ID NO: 37306 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
atgggggcgggggtgagata

SEQ ID NO: 37307 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gatgggggcgggggtgagat

SEQ ID NO: 37308 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gggatgatgggggcgggggt

SEQ ID NO: 37309 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gaaagggatgatgggggcgg

SEQ ID NO: 37310 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ggaaagggatgatgggggcg

SEQ ID NO: 37311 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aggaaagggatgatgggggc

SEQ ID NO: 37312 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
gaggaaagggatgatggggg

SEQ ID NO: 37313 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
agggaggaaagggatgatgg

SEQ ID NO: 37314 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aagggaggaaagggatgatg

SEQ ID NO: 37315 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gaagggaggaaagggatgat

SEQ ID NO: 37316 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ggaagggaggaaagggatga

SEQ ID NO: 37317 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ctgagcaggaagggaggaaa

SEQ ID NO: 37318 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gctgagcaggaagggaggaa

SEQ ID NO: 37319 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgctgagcaggaagggagga

SEQ ID NO: 37320 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
attctgctgagcaggaaggg

SEQ ID NO: 37321 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gattctgctgagcaggaagg

SEQ ID NO: 37322 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ccgattctgctgagcaggaa

SEQ ID NO: 37323 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gccgattctgctgagcagga

SEQ ID NO: 37324 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agccgattctgctgagcagg

SEQ ID NO: 37325 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
attagccgattctgctgagc

SEQ ID NO: 37326 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cattagccgattctgctgag

SEQ ID NO: 37327 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aaacattagccgattctgct

SEQ ID NO: 37328 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aagtgacttctcggaaacat

SEQ ID NO: 37329 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
agccacacaaagtgacttct

SEQ ID NO: 37330 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gctccccaccaagccacaca

SEQ ID NO: 37331 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tttttctccagctccccacc

SEQ ID NO: 37332 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tctgctccggagtttttctc

SEQ ID NO: 37333 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tccccacctcctctgctccg

SEQ ID NO: 37334 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
ggtccccacctcctctgctc

SEQ ID NO: 37335 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
cagactcagggctttgccat

SEQ ID NO: 37336 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cagccactgccccagactca

SEQ ID NO: 37337 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ccagccactgccccagactc

SEQ ID NO: 37338 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cccagccactgccccagact

SEQ ID NO: 37339 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tggctccccagccactgccc

SEQ ID NO: 37340 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ggcggtgttgtctggctccc

SEQ ID NO: 37341 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gctggcctggcggtgttgtc

SEQ ID NO: 37342 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
tcggggaggcgctggcctgg

SEQ ID NO: 37343 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aggtcggggaggcgctggcc

SEQ ID NO: 37344 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gcccaaggtcggggaggcgc

SEQ ID NO: 37345 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttcagagcccaaggtcgggg

SEQ ID NO: 37346 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cttcagagcccaaggtcggg

SEQ ID NO: 37347 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ctcttcagagcccaaggtcg

SEQ ID NO: 37348 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
actcttcagagcccaaggtc

SEQ ID NO: 37349 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
gactcttcagagcccaaggt

SEQ ID NO: 37350 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cctagactcttcagagccca

SEQ ID NO: 37351 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gcctagactcttcagagccc

SEQ ID NO: 37352 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ttcccagcctagactcttca

SEQ ID NO: 37353 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aattcccagcctagactctt

SEQ ID NO: 37354 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gaagaaaccaattcccagcc

SEQ ID NO: 37355 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ctacggaagaaaccaattcc

SEQ ID NO: 37356 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttgtgagcaaagccctacgg

SEQ ID NO: 37357 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
cggttgtgagcaaagcccta

SEQ ID NO: 37358 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cccactcgcggttgtgagca

SEQ ID NO: 37359 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
accgccccactcgcggttgt

SEQ ID NO: 37360 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
gagcgtcaccgccccactcg

SEQ ID NO: 37361 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
atagcctagataccggtctt

SEQ ID NO: 37362 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
agaaaacatagcctagatac

SEQ ID NO: 37363 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
agaaaacagaaaacatagcc

SEQ ID NO: 37364 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tataaagaaaacagaaaaca

SEQ ID NO: 37365 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atacatatatataaagaaaa

SEQ ID NO: 37366 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tttatatatacatatatata

SEQ ID NO: 37367 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgtattatttgcttgcctgg

SEQ ID NO: 37368 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aaatgtattatttgcttgcc

SEQ ID NO: 37369 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
attcttcactgcatcttcga

SEQ ID NO: 37370 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ccacgtttctttccccacct

SEQ ID NO: 37371 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cccacgtttctttccccacc

SEQ ID NO: 37372 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gggtcccaggtctggaaaag

SEQ ID NO: 37373 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atcgggtcccaggtctggaa

SEQ ID NO: 37374 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agataatcgggtcccaggtc

SEQ ID NO: 37375 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tattcagataatcgggtccc

SEQ ID NO: 37376 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atattcagataatcgggtcc

SEQ ID NO: 37377 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gatggcatattcagataatc

SEQ ID NO: 37378 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
tgatggcatattcagataat

SEQ ID NO: 37379 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
catatgactgatggcatatt

SEQ ID NO: 37380 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttcagaacccatatgactga

SEQ ID NO: 37381 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ctcctaccagctctgaaatt

SEQ ID NO: 37382 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
attttcacagtcgctcctac

SEQ ID NO: 37383 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttttaaaaaatttattttca

SEQ ID NO: 37384 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cctcccaggctgctgtagga

SEQ ID NO: 37385 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tcttcctcccaggctgctgt

SEQ ID NO: 37386 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttcttcctcccaggctgctg

SEQ ID NO: 37387 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tttccattgttcttcctccc

SEQ ID NO: 37388 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gtttccattgttcttcctcc

SEQ ID NO: 37389 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tttcctgtttctctttgaga

SEQ ID NO: 37390 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gaaatttcctgtttctcttt

SEQ ID NO: 37391 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
cctttgatttcttcccttgg

SEQ ID NO: 37392 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
catcctttgatttcttccct

SEQ ID NO: 37393 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttgagaggcaccctgcccta

SEQ ID NO: 37394 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aagtggtctgcccttttgag

SEQ ID NO: 37395 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aaagtggtctgcccttttga

SEQ ID NO: 37396 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gcaaagtggtctgccctttt

SEQ ID NO: 37397 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ctagtgtttatcctgcaaag

SEQ ID NO: 37398 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tcactagtgtttatcctgca

SEQ ID NO: 37399 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ataataaaagtgcccgtcac

SEQ ID NO: 37400 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ggtgtggaagcaaataataa

SEQ ID NO: 37401 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttccatgatagaaggtgtgg

SEQ ID NO: 37402 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
catttccatgatagaaggtg

SEQ ID NO: 37403 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
agcatcatttccatgataga

SEQ ID NO: 37404 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aagcatcatttccatgatag

SEQ ID NO: 37405 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tctaagcatcatttccatga

SEQ ID NO: 37406 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atttccttccggttatctct

SEQ ID NO: 37407 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
cctgggatttgatttccttc

SEQ ID NO: 37408 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
agcagggaaaagtagaccct

SEQ ID NO: 37409 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
cagcagggaaaagtagaccc

SEQ ID NO: 37410 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aagaaagcagcagggaaaag

SEQ ID NO: 37411 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gcaaagaaagcagcagggaa

SEQ ID NO: 37412 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cagaagcaaagaaagcagca

SEQ ID NO: 37413 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tcagaagcaaagaaagcagc

SEQ ID NO: 37414 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ctcagaagcaaagaaagcag

SEQ ID NO: 37415 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aatctcagaagcaaagaaag

SEQ ID NO: 37416 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
acaaatctcagaagcaaaga

SEQ ID NO: 37417 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
caggacaaatctcagaagca

SEQ ID NO: 37418 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agccccaggacaaatctcag

SEQ ID NO: 37419 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
caaagccccaggacaaatct

SEQ ID NO: 37420 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aatgtaaggtccaaagcccc

SEQ ID NO: 37421 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gaatgtaaggtccaaagccc

SEQ ID NO: 37422 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agtcaagaatgtaaggtcca

SEQ ID NO: 37423 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tcttacaagtcaagaatgta

SEQ ID NO: 37424 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atcttacaagtcaagaatgt

SEQ ID NO: 37425 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aatagcacatcttacaagtc

SEQ ID NO: 37426 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ccttcaatagcacatcttac

SEQ ID NO: 37427 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ctgaagtttccttccttcaa

SEQ ID NO: 37428 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttgcacagtctcagtcactg

SEQ ID NO: 37429 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tcaccttcattgcacagtct

SEQ ID NO: 37430 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gctagttcaccttcattgca

SEQ ID NO: 37431 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gagaattatcacaagtgagc

SEQ ID NO: 37432 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cactgagaattatcacaagt

SEQ ID NO: 37433 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atggcactgagaattatcac

SEQ ID NO: 37434 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tttgtccaggatatggcact

SEQ ID NO: 37435 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aaggcgatttgtccaggata

SEQ ID NO: 37436 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gaagagaaggcgatttgtcc

SEQ ID NO: 37437 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ggaagagaaggcgatttgtc

SEQ ID NO: 37438 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
accaccaatcagggaagaga

SEQ ID NO: 37439 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
taccaccaatcagggaagag

SEQ ID NO: 37440 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
atctaccaccaatcagggaa

SEQ ID NO: 37441 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atatctaccaccaatcaggg

SEQ ID NO: 37442 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cctatatctaccaccaatca

SEQ ID NO: 37443 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tcctatatctaccaccaatc

SEQ ID NO: 37444 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttcctatatctaccaccaat

SEQ ID NO: 37445 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aaagaccattattcctattg

SEQ ID NO: 37446 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
attgcttgcatctaataaaa

SEQ ID NO: 37447 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
attttaaaaataaaagaatg

SEQ ID NO: 37448 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaataaaattttaaaaataa

SEQ ID NO: 37449 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aaatctctgtaccctccctt

SEQ ID NO: 37450 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tgtgggagtagcggttatgt

SEQ ID NO: 37451 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gtgtgggagtagcggttatg

SEQ ID NO: 37452 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
ctattcttgtgtgggagtag

SEQ ID NO: 37453 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aggctattcttgtgtgggag

SEQ ID NO: 37454 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gggaggctattcttgtgtgg

SEQ ID NO: 37455 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gggggaggctattcttgtgt

SEQ ID NO: 37456 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tgggggaggctattcttgtg

SEQ ID NO: 37457 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gggaatgttgataatggggg

SEQ ID NO: 37458 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ggggaatgttgataatgggg

SEQ ID NO: 37459 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gtggggaatgttgataatgg

SEQ ID NO: 37460 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ggtggggaatgttgataatg

SEQ ID NO: 37461 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tggtggggaatgttgataat

SEQ ID NO: 37462 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ctggtggggaatgttgataa

SEQ ID NO: 37463 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
acaaatgtttcattctggtg

SEQ ID NO: 37464 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aacaaatgtttcattctggt

SEQ ID NO: 37465 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
taacaaatgtttcattctgg

SEQ ID NO: 37466 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttttaacaaatgtttcattc

SEQ ID NO: 37467 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agataatgaaacctcaaagt

SEQ ID NO: 37468 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgggagataatgaaacctca

SEQ ID NO: 37469 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
atgtgaactacagaccttgg

SEQ ID NO: 37470 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aaatgtgaactacagacctt

SEQ ID NO: 37471 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
taaatgtgaactacagacct

SEQ ID NO: 37472 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ctaaccctaaatgtgaacta

SEQ ID NO: 37473 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
catagaatggacaacaccat

SEQ ID NO: 37474 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
atttgcctaaccccatagaa

SEQ ID NO: 37475 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tatatatttgcctaacccca

SEQ ID NO: 37476 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tctgtaagatactgtaatgg

SEQ ID NO: 37477 - DNA, 20 bp, synthetic construct
  source 1..20: mol_type = other DNA; note = Description ofArtificial Sequence: Synthetic oligonucleotide; note = Target: SCN9A; (-) strand; PAM type: NRG; PAM sequence: TGG
tactctgtaagatactgtaa

SEQ ID NO: 37478 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gagaactgaaattactctgt

SEQ ID NO: 37479 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ggaacacagagaattcagga

SEQ ID NO: 37480 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gtggaacacagagaattcag

SEQ ID NO: 37481 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aagtggaacacagagaattc

SEQ ID NO: 37482 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
taagtggaacacagagaatt

SEQ ID NO: 37483 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
agatgaataagtggaacaca

SEQ ID NO: 37484 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ggagatgaataagtggaaca

SEQ ID NO: 37485 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tgaaatgggagatgaataag

SEQ ID NO: 37486 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ggttgaaatgggagatgaat

SEQ ID NO: 37487 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cttgccaggggttgaaatgg

SEQ ID NO: 37488 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tacttgccaggggttgaaat

SEQ ID NO: 37489 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gtacttgccaggggttgaaa

SEQ ID NO: 37490 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aaatgatcagtacttgccag

SEQ ID NO: 37491 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aaaatgatcagtacttgcca

SEQ ID NO: 37492 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
taaaatgatcagtacttgcc

SEQ ID NO: 37493 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gtaaaatgatcagtacttgc

SEQ ID NO: 37494 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tataaagacagtaaaatgat

SEQ ID NO: 37495 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
agaaggcaaaactataaaga

SEQ ID NO: 37496 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ctggagaaggcaaaactata

SEQ ID NO: 37497 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
actataggatatcctggaga

SEQ ID NO: 37498 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aactataggatatcctggag

SEQ ID NO: 37499 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tgcaactataggatatcctg

SEQ ID NO: 37500 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
attgcaactataggatatcc

SEQ ID NO: 37501 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttctgtattattgcaactat

SEQ ID NO: 37502 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
attctgtattattgcaacta

SEQ ID NO: 37503 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tgaaaggagtcaatctgaaa

SEQ ID NO: 37504 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gtgaaaggagtcaatctgaa

SEQ ID NO: 37505 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agtgaaaggagtcaatctga

SEQ ID NO: 37506 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
agcatattgctaagtgaaag

SEQ ID NO: 37507 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aaagcatattgctaagtgaa

SEQ ID NO: 37508 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaaagcatattgctaagtga

SEQ ID NO: 37509 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaaactaaaagcatattgct

SEQ ID NO: 37510 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aagccatggaggaaaactaa

SEQ ID NO: 37511 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
caagctatgaaaagccatgg

SEQ ID NO: 37512 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tcaagctatgaaaagccatg

SEQ ID NO: 37513 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tatcaagctatgaaaagcca

SEQ ID NO: 37514 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atgagctatcaagctatgaa

SEQ ID NO: 37515 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ctgtaaagaaatgagctatc

SEQ ID NO: 37516 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
attcagcactgtaaagaaat

SEQ ID NO: 37517 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gaatattattcagcactgta

SEQ ID NO: 37518 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ccagtcaatggaatattatt

SEQ ID NO: 37519 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
actatggtaccaccagtcaa

SEQ ID NO: 37520 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tgaataaactatggtaccac

SEQ ID NO: 37521 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gtaggtgaatgaataaacta

SEQ ID NO: 37522 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
caaacaagatgtccttcagt

SEQ ID NO: 37523 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gcaaacaagatgtccttcag

SEQ ID NO: 37524 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gaagcaaacaagatgtcctt

SEQ ID NO: 37525 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gctaaaacttggaagcaaac

SEQ ID NO: 37526 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gcataattgctaaaacttgg

SEQ ID NO: 37527 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tacgcataattgctaaaact

SEQ ID NO: 37528 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cttcacaaagatgtttatag

SEQ ID NO: 37529 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ccttcacaaagatgtttata

SEQ ID NO: 37530 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aaccttcacaaagatgttta

SEQ ID NO: 37531 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tccacacagtaaccttcaca

SEQ ID NO: 37532 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gacttgaaaacatgtccaca

SEQ ID NO: 37533 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gctccttgatgttcacccaa

SEQ ID NO: 37534 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgctccttgatgttcaccca

SEQ ID NO: 37535 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
catactctcaccatatgatc

SEQ ID NO: 37536 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ccactttgaggacagtgtag

SEQ ID NO: 37537 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cagccactttgaggacagtg

SEQ ID NO: 37538 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tgctccagccactttgagga

SEQ ID NO: 37539 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aaaatgctccagccactttg

SEQ ID NO: 37540 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
caaaatgctccagccacttt

SEQ ID NO: 37541 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ggtgggaatgcaaaatgctc

SEQ ID NO: 37542 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aactctcatgtattgctggt

SEQ ID NO: 37543 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gaactctcatgtattgctgg

SEQ ID NO: 37544 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
caggaactctcatgtattgc

SEQ ID NO: 37545 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ggccaaggatgtgaggcaac

SEQ ID NO: 37546 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tggccaaggatgtgaggcaa

SEQ ID NO: 37547 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aagttctggccaaggatgtg

SEQ ID NO: 37548 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
caagttctggccaaggatgt

SEQ ID NO: 37549 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
atgatatcaagttctggcca

SEQ ID NO: 37550 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gatgatatcaagttctggcc

SEQ ID NO: 37551 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
acactgatgatatcaagttc

SEQ ID NO: 37552 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tccagaacactgatgatatc

SEQ ID NO: 37553 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gtattggaataaccaaaatc

SEQ ID NO: 37554 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
agataccaccacatatgtat

SEQ ID NO: 37555 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
atggtatcaacaatgggcat

SEQ ID NO: 37556 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
acacttatggtatcaacaat

SEQ ID NO: 37557 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aacacttatggtatcaacaa

SEQ ID NO: 37558 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tgcaaatcaaataacactta

SEQ ID NO: 37559 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
atccacatcatatatcacag

SEQ ID NO: 37560 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gatccacatcatatatcaca

SEQ ID NO: 37561 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgatccacatcatatatcac

SEQ ID NO: 37562 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gtgatccacatcatatatca

SEQ ID NO: 37563 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttgcaaataagcatataaaa

SEQ ID NO: 37564 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
attgcaaataagcatataaa

SEQ ID NO: 37565 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aagatgcacatattgcaaat

SEQ ID NO: 37566 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tataccttaacagaccaaag

SEQ ID NO: 37567 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ccatataccttaacagacca

SEQ ID NO: 37568 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aaatgggccatataccttaa

SEQ ID NO: 37569 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aataacccaatgaaaaaaat

SEQ ID NO: 37570 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aaataacccaatgaaaaaaa

SEQ ID NO: 37571 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttaaaactcaacaacaagaa

SEQ ID NO: 37572 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaagcttaaaactcaacaac

SEQ ID NO: 37573 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttaaccaaaatatacaaata

SEQ ID NO: 37574 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgttagataaatatttgcaa

SEQ ID NO: 37575 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aacggacaacaagccagtgt

SEQ ID NO: 37576 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tgcaaaaacggacaacaagc

SEQ ID NO: 37577 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gctctgcaaaaacggacaac

SEQ ID NO: 37578 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
aaacttctgctctgcaaaaa

SEQ ID NO: 37579 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tataagagacataattgcta

SEQ ID NO: 37580 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ctataagagacataattgct

SEQ ID NO: 37581 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
agcaaaggcataatctataa

SEQ ID NO: 37582 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
acagcaaaggcataatctat

SEQ ID NO: 37583 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tattctagatataacagcaa

SEQ ID NO: 37584 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttattctagatataacagca

SEQ ID NO: 37585 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atgtgttattctagatataa

SEQ ID NO: 37586 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
atctaacatatgtgttattc

SEQ ID NO: 37587 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgcattatatattccactct

SEQ ID NO: 37588 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tataacatgttataatatat

SEQ ID NO: 37589 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
atataacatgttataatata

SEQ ID NO: 37590 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
acatatattataacataata

SEQ ID NO: 37591 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttgttaatggatgcttaaag

SEQ ID NO: 37592 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttcttgttaatggatgctta

SEQ ID NO: 37593 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gaatagtaagttcttgttaa

SEQ ID NO: 37594 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ctagatatattgagaatagt

SEQ ID NO: 37595 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gaacctagatatattgagaa

SEQ ID NO: 37596 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aacaagaacctagatatatt

SEQ ID NO: 37597 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gaagatctctaacaagaacc

SEQ ID NO: 37598 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tatgtttgaagatctctaac

SEQ ID NO: 37599 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tttccaggattttatgtttg

SEQ ID NO: 37600 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttttggttttatcattttcc

SEQ ID NO: 37601 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tttttggttttatcattttc

SEQ ID NO: 37602 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gaccaagaggattttatttt

SEQ ID NO: 37603 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gatccctcagtcagaccaag

SEQ ID NO: 37604 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
ggatccctcagtcagaccaa

SEQ ID NO: 37605 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agggatccctcagtcagacc

SEQ ID NO: 37606 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cctgcaagggatccctcagt

SEQ ID NO: 37607 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aaatcctgcaagggatccct

SEQ ID NO: 37608 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tcacagggaaaatcctgcaa

SEQ ID NO: 37609 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ctcacagggaaaatcctgca

SEQ ID NO: 37610 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gctcacagggaaaatcctgc

SEQ ID NO: 37611 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gctttgcctatgagctcaca

SEQ ID NO: 37612 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgctttgcctatgagctcac

SEQ ID NO: 37613 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
atgctttgcctatgagctca

SEQ ID NO: 37614 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
atacctaatgctttgcctat

SEQ ID NO: 37615 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ttggaacatgaaagaaaatt

SEQ ID NO: 37616 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gttggaacatgaaagaaaat

SEQ ID NO: 37617 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aataaatagttggaacatga

SEQ ID NO: 37618 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
atggaaaggaaataaatagt

SEQ ID NO: 37619 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
agaaatggaaaggaaataaa

SEQ ID NO: 37620 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ggcacataaaagaaatggaa

SEQ ID NO: 37621 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tggcacataaaagaaatgga

SEQ ID NO: 37622 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ggaatggcacataaaagaaa

SEQ ID NO: 37623 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agactaggaatggcacataa

SEQ ID NO: 37624 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aatgttctgtagactaggaa

SEQ ID NO: 37625 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cagctaatgttctgtagact

SEQ ID NO: 37626 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
acagctaatgttctgtagac

SEQ ID NO: 37627 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cacaaacagctaatgttctg

SEQ ID NO: 37628 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aagagcaagaaaaacacaaa

SEQ ID NO: 37629 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tctagggctgccaaaagagc

SEQ ID NO: 37630 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aatttctagggctgccaaaa

SEQ ID NO: 37631 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aaaatttctagggctgccaa

SEQ ID NO: 37632 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aaaccaagataaaatttcta

SEQ ID NO: 37633 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
taaaccaagataaaatttct

SEQ ID NO: 37634 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttaaaccaagataaaatttc

SEQ ID NO: 37635 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
actttttctgggtttaaacc

SEQ ID NO: 37636 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tttggaaagatactttttct

SEQ ID NO: 37637 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
atttggaaagatactttttc

SEQ ID NO: 37638 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tatttaataagaaatttgga

SEQ ID NO: 37639 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gtagtatttaataagaaatt

SEQ ID NO: 37640 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgtgcagtgtagtatttaat

SEQ ID NO: 37641 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
actctcaaggctgtgcagtg

SEQ ID NO: 37642 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aatgaactctcaaggctgtg

SEQ ID NO: 37643 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tagtgtttaatgaactctca

SEQ ID NO: 37644 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttagtgtttaatgaactctc

SEQ ID NO: 37645 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ctacatctgacgctgtcatt

SEQ ID NO: 37646 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttgtctggttcccttaattc

SEQ ID NO: 37647 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tcaaccagacaggctttgtc

SEQ ID NO: 37648 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
attggctttttcaaccagac

SEQ ID NO: 37649 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tattggctttttcaaccaga

SEQ ID NO: 37650 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tggttattggctttttcaac

SEQ ID NO: 37651 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
attaggaacttattggttat

SEQ ID NO: 37652 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aaatatgattaggaacttat

SEQ ID NO: 37653 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ggtcagttgtaaatatgatt

SEQ ID NO: 37654 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aggtcagttgtaaatatgat

SEQ ID NO: 37655 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ctatctaagttacggaaggt

SEQ ID NO: 37656 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttttctatctaagttacgga

SEQ ID NO: 37657 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tttttctatctaagttacgg

SEQ ID NO: 37658 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
acatttttctatctaagtta

SEQ ID NO: 37659 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atttccacatttttctatct

SEQ ID NO: 37660 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tggtatggattgtatgatgt

SEQ ID NO: 37661 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttcttattcctattctggta

SEQ ID NO: 37662 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
taaaattcttattcctattc

SEQ ID NO: 37663 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
atccatttatttctcactaa

SEQ ID NO: 37664 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tatccatttatttctcacta

SEQ ID NO: 37665 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atatccatttatttctcact

SEQ ID NO: 37666 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttgtggaaaatacagaagtg

SEQ ID NO: 37667 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ggcaattgtggaaaatacag

SEQ ID NO: 37668 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
agtggcaattgtggaaaata

SEQ ID NO: 37669 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gaaaattgcagtggcaattg

SEQ ID NO: 37670 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tacagttttgaaaattgcag

SEQ ID NO: 37671 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttctacagttttgaaaattg

SEQ ID NO: 37672 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tgttcttccagaaacttcta

SEQ ID NO: 37673 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ctgtctattttttgttcttc

SEQ ID NO: 37674 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tagagaaaaacaaactcttt

SEQ ID NO: 37675 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
tttctaatcctatttaatta

SEQ ID NO: 37676 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tttttctaatcctatttaat

SEQ ID NO: 37677 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cagccaatattagaaggtaa

SEQ ID NO: 37678 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gccgtgcagccaatattaga

SEQ ID NO: 37679 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgccgtgcagccaatattag

SEQ ID NO: 37680 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tattgccgtgcagccaatat

SEQ ID NO: 37681 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tactttgtaatattgccgtg

SEQ ID NO: 37682 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ttattcttctattttcacaa

SEQ ID NO: 37683 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tacttttgaatcctactttt

SEQ ID NO: 37684 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttctttttagttataatttg

SEQ ID NO: 37685 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ttgtatattctatttctttt

SEQ ID NO: 37686 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttttcttcagttgtttcatt

SEQ ID NO: 37687 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tttaggaaacctcttttctt

SEQ ID NO: 37688 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
actcagatgccaatacattt

SEQ ID NO: 37689 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cactcagatgccaatacatt

SEQ ID NO: 37690 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aaattagacgagcaaacact

SEQ ID NO: 37691 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cagaccacgtcaaattagac

SEQ ID NO: 37692 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
aaatccagaccacgtcaaat

SEQ ID NO: 37693 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gttttctggccaaaaaaatc

SEQ ID NO: 37694 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ttttcttcacatcagttttc

SEQ ID NO: 37695 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
acatttatttttcttcacat

SEQ ID NO: 37696 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
actaagcatctactacatgc

SEQ ID NO: 37697 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aatcaattaatatacttact

SEQ ID NO: 37698 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ggggaaaattcttcaggaat

SEQ ID NO: 37699 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gacactggggaaaattcttc

SEQ ID NO: 37700 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tgacactggggaaaattctt

SEQ ID NO: 37701 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
atcagtggactatgacactg

SEQ ID NO: 37702 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
catcagtggactatgacact

SEQ ID NO: 37703 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ccatcagtggactatgacac

SEQ ID NO: 37704 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tagggtaagggacccatcag

SEQ ID NO: 37705 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tgttagggtaagggacccat

SEQ ID NO: 37706 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
caaaaccattgttagggtaa

SEQ ID NO: 37707 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gcaaaaccattgttagggta

SEQ ID NO: 37708 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
agcaaaaccattgttagggt

SEQ ID NO: 37709 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
tatcagcaaaaccattgtta

SEQ ID NO: 37710 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ttatcagcaaaaccattgtt

SEQ ID NO: 37711 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
attatcagcaaaaccattgt

SEQ ID NO: 37712 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ctccacagaaagcacattat

SEQ ID NO: 37713 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atcaaaaataactccacaga

SEQ ID NO: 37714 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tttgatcaaaaataactcca

SEQ ID NO: 37715 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
caagggaatgtcgataacaa

SEQ ID NO: 37716 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
ctaatggaagacttctacaa

SEQ ID NO: 37717 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tctaatggaagacttctaca

SEQ ID NO: 37718 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atctaatggaagacttctac

SEQ ID NO: 37719 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tttgtccccttatctaatgg

SEQ ID NO: 37720 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tattttgtccccttatctaa

SEQ ID NO: 37721 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
gttgcccaatgactgaaaac

SEQ ID NO: 37722 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ctctagggatcactgtctta

SEQ ID NO: 37723 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
cactttctttctcttctcta

SEQ ID NO: 37724 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tcactttctttctcttctct

SEQ ID NO: 37725 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ctcactttctttctcttctc

SEQ ID NO: 37726 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gtagtatgcagagacaatca

SEQ ID NO: 37727 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gaaactttgtgtagtatgca

SEQ ID NO: 37728 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tagaaactttgtgtagtatg

SEQ ID NO: 37729 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tgtggtttagaaactttgtg

SEQ ID NO: 37730 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
catcttcctgagctgtggtt

SEQ ID NO: 37731 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
gtttccatcttcctgagctg

SEQ ID NO: 37732 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cttcatgtttccatcttcct

SEQ ID NO: 37733 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
cctatcaaactcttattttc

SEQ ID NO: 37734 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
taaacaaattctagctccct

SEQ ID NO: 37735 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tgtcccaaataaacaaattc

SEQ ID NO: 37736 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ctgttcagctcccttgtctt

SEQ ID NO: 37737 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tctgttcagctcccttgtct

SEQ ID NO: 37738 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tctctggtatactctctgtt

SEQ ID NO: 37739 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
ggtctctttctacagatctc

SEQ ID NO: 37740 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aaacttgaggtctctttcta

SEQ ID NO: 37741 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgctgtcaagcaaaaacttg

SEQ ID NO: 37742 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
atgctgtcaagcaaaaactt

SEQ ID NO: 37743 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
cacaattgcagaatgctgtc

SEQ ID NO: 37744 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tttttgttttcacacaattg

SEQ ID NO: 37745 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gtagttctttctctggctta

SEQ ID NO: 37746 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgtagttctttctctggctt

SEQ ID NO: 37747 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ctgtagttctttctctggct

SEQ ID NO: 37748 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
catgactgtagttctttctc

SEQ ID NO: 37749 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tgttaggcaatgcatgactg

SEQ ID NO: 37750 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
cggtacatatctccattgtt

SEQ ID NO: 37751 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tcggtacatatctccattgt

SEQ ID NO: 37752 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CGG
ttgcctagtgacacatttct

SEQ ID NO: 37753 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tctatgatgttaaaattgcc

SEQ ID NO: 37754 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tataccatctaggtttgtgt

SEQ ID NO: 37755 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tgtagtagactataccatct

SEQ ID NO: 37756 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
atgtagtagactataccatc

SEQ ID NO: 37757 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
cataaagactaagtatgtag

SEQ ID NO: 37758 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
taccataaagactaagtatg

SEQ ID NO: 37759 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
taggctataccataaagact

SEQ ID NO: 37760 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
aagcaataggctataccata

SEQ ID NO: 37761 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gtttatagcctagaagcaat

SEQ ID NO: 37762 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ggtttatagcctagaagcaa

SEQ ID NO: 37763 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgtacaggtttatagcctag

SEQ ID NO: 37764 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tgttgtacaggtttatagcc

SEQ ID NO: 37765 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
taacatgttgtacaggttta

SEQ ID NO: 37766 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
agtacagtaacatgttgtac

SEQ ID NO: 37767 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cagtacagtaacatgttgta

SEQ ID NO: 37768 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gtgttacaattgtctcagta

SEQ ID NO: 37769 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
ccactgtgttacaattgtct

SEQ ID NO: 37770 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tttctatgtttaggtatgat

SEQ ID NO: 37771 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
actgtaacttttctatgttt

SEQ ID NO: 37772 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
tactgtaacttttctatgtt

SEQ ID NO: 37773 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
catatatgatggtggtccca

SEQ ID NO: 37774 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
acagactgcatatatgatgg

SEQ ID NO: 37775 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
aggacagactgcatatatga

SEQ ID NO: 37776 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gataacacttcagtcaagga

SEQ ID NO: 37777 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
gccagataacacttcagtca

SEQ ID NO: 37778 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
tgccagataacacttcagtc

SEQ ID NO: 37779 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
tcatgtgccagataacactt

SEQ ID NO: 37780 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
cagtcatgtcagtcatgtgc

SEQ ID NO: 37781 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
acttaagattacagtcatgt

SEQ ID NO: 37782 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
taacctgctacttaagatta

SEQ ID NO: 37783 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gaatttttaacctgctactt

SEQ ID NO: 37784 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
actatccctgtgtgaggtcc

SEQ ID NO: 37785 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
aatattactatccctgtgtg

SEQ ID NO: 37786 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
aaatattactatccctgtgt

SEQ ID NO: 37787 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
tcttttcactttgactgggg

SEQ ID NO: 37788 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
gtcttttcactttgactggg

SEQ ID NO: 37789 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
aggtcttttcactttgactg

SEQ ID NO: 37790 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GGG
gaggtcttttcactttgact

SEQ ID NO: 37791 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TGG
tgaggtcttttcactttgac

SEQ ID NO: 37792 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AGG
ccaatatctcctgtgttttg

SEQ ID NO: 37793 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
cccaatatctcctgtgtttt

SEQ ID NO: 37794 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: GAG
taagataagacccttctgca

SEQ ID NO: 37795 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
gctaagataagacccttctg

SEQ ID NO: 37796 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
ttcagccccactgctaagat

SEQ ID NO: 37797 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
gttaattcagccccactgct

SEQ ID NO: 37798 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: CAG
aacgttagttaaagttaatt

SEQ ID NO: 37799 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: AAG
atccagagcaacgttagtta

SEQ ID NO: 37800 - DNA, 20 bp, synthetic construct
  source 1..20: mol_type = other DNA; note = Description of Artificial Sequence: Synthetic oligonucleotide; note = Target: SCN9A; (-) strand; PAM type: NRG; PAM sequence: TAG
ggataaatccagagcaacgt

SEQ ID NO: 37801 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
actaatagctaaggtaatgt

SEQ ID NO: 37802 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atccatgattcatactttta

SEQ ID NO: 37803 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catacttttatagacattgt

SEQ ID NO: 37804 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tacttttatagacattgtca

SEQ ID NO: 37805 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttatagacattgtcagagat

SEQ ID NO: 37806 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agagatcagtcgttgtcaac

SEQ ID NO: 37807 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gagatcagtcgttgtcaact

SEQ ID NO: 37808 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agatcagtcgttgtcaactg

SEQ ID NO: 37809 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcagtcgttgtcaactgggg

SEQ ID NO: 37810 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggggaagattttgtccccct

SEQ ID NO: 37811 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttgtccccctgagaacatt

SEQ ID NO: 37812 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccccctgagaacatttagca

SEQ ID NO: 37813 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctgagaacatttagcaaaga

SEQ ID NO: 37814 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgagaacatttagcaaagat

SEQ ID NO: 37815 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gagaacatttagcaaagatg

SEQ ID NO: 37816 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atttttatttgtcataactg

SEQ ID NO: 37817 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atttgtcataactgtggaat

SEQ ID NO: 37818 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttgtcataactgtggaatt

SEQ ID NO: 37819 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taggaatgtttattgatatc

SEQ ID NO: 37820 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggaatgtttattgatatcta

SEQ ID NO: 37821 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaatgtttattgatatctag

SEQ ID NO: 37822 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtttattgatatctagaggt

SEQ ID NO: 37823 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttattgatatctagaggtta

SEQ ID NO: 37824 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gatatctagaggttagagac

SEQ ID NO: 37825 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gctaaacatcccaccatgca

SEQ ID NO: 37826 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctaaacatcccaccatgcac

SEQ ID NO: 37827 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acatcccaccatgcacagga

SEQ ID NO: 37828 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caggacagccactcacaaca

SEQ ID NO: 37829 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actcacaacaaagaattatc

SEQ ID NO: 37830 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattatccagctcaaatatc

SEQ ID NO: 37831 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atatcaagattgccaatatt

SEQ ID NO: 37832 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attgccaatattgagaaact

SEQ ID NO: 37833 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgccaatattgagaaactc

SEQ ID NO: 37834 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atattgagaaactcaggcct

SEQ ID NO: 37835 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attgagaaactcaggcctta

SEQ ID NO: 37836 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ataaatgtctgattttaatg

SEQ ID NO: 37837 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaatgtagaatgtatatga

SEQ ID NO: 37838 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atatgaaagttttcattttt

SEQ ID NO: 37839 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttttttttctactttgtta

SEQ ID NO: 37840 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttctactttgttaaagcta

SEQ ID NO: 37841 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctactttgttaaagctata

SEQ ID NO: 37842 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctactttgttaaagctatag

SEQ ID NO: 37843 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaggaaaaacacttttaact

SEQ ID NO: 37844 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acttagtccttcaaaaatgc

SEQ ID NO: 37845 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctatactaattttattttgt

SEQ ID NO: 37846 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tactaattttattttgtgag

SEQ ID NO: 37847 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taattttattttgtgagcag

SEQ ID NO: 37848 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aattttattttgtgagcagt

SEQ ID NO: 37849 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttattttgtgagcagtggga

SEQ ID NO: 37850 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccactcaacttaccatgtga

SEQ ID NO: 37851 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taccatgtgaaagacatgta

SEQ ID NO: 37852 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagacatgtatagtctctct

SEQ ID NO: 37853 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agacatgtatagtctctctc

SEQ ID NO: 37854 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgtatagtctctctcaggc

SEQ ID NO: 37855 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atagtctctctcaggccaga

SEQ ID NO: 37856 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctctcaggccagaaagcac

SEQ ID NO: 37857 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaaagcactggcactgtat

SEQ ID NO: 37858 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctggcactgtataagaatgt

SEQ ID NO: 37859 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaatacactatacttttgtt

SEQ ID NO: 37860 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacactatacttttgttgag

SEQ ID NO: 37861 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgttgagaagatcctgcaaa

SEQ ID NO: 37862 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagaagatcctgcaaacaga

SEQ ID NO: 37863 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caaacagaaagaaaactatt

SEQ ID NO: 37864 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaacagaaagaaaactattg

SEQ ID NO: 37865 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagaaaactattgaggctg

SEQ ID NO: 37866 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actattgaggctgaagcaca

SEQ ID NO: 37867 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaggctgaagcacacagatt

SEQ ID NO: 37868 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgaagcacacagattaaga

SEQ ID NO: 37869 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgaagcacacagattaagat

SEQ ID NO: 37870 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaagcacacagattaagata

SEQ ID NO: 37871 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cacacagattaagataggga

SEQ ID NO: 37872 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cacagattaagatagggaaa

SEQ ID NO: 37873 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acagattaagatagggaaag

SEQ ID NO: 37874 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cagattaagatagggaaaga

SEQ ID NO: 37875 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attaagatagggaaagaggg

SEQ ID NO: 37876 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatagggaaagagggaagat

SEQ ID NO: 37877 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tagggaaagagggaagataa

SEQ ID NO: 37878 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggaaagagggaagataagag

SEQ ID NO: 37879 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agagggaagataagagcagt

SEQ ID NO: 37880 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagggaagataagagcagtg

SEQ ID NO: 37881 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taagagcagtgaggctgaca

SEQ ID NO: 37882 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcagtgaggctgacatggtg

SEQ ID NO: 37883 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagtgaggctgacatggtgt

SEQ ID NO: 37884 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agtgaggctgacatggtgta

SEQ ID NO: 37885 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aggctgacatggtgtagggc

SEQ ID NO: 37886 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgacatggtgtagggctgga

SEQ ID NO: 37887 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtgtagggctggaaagcttg

SEQ ID NO: 37888 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tggaaagcttgtagaacttg

SEQ ID NO: 37889 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagcttgtagaacttgtaga

SEQ ID NO: 37890 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtagaacttgtagacagtaa

SEQ ID NO: 37891 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acttgtagacagtaatagta

SEQ ID NO: 37892 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgtagacagtaatagtata

SEQ ID NO: 37893 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gagtttgtaaaatctttgct

SEQ ID NO: 37894 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtttgtaaaatctttgctg

SEQ ID NO: 37895 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaatctttgctgaggattt

SEQ ID NO: 37896 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agaatttatcatcataataa

SEQ ID NO: 37897 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatttatcatcataataatg

SEQ ID NO: 37898 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ataataatggagaaatatta

SEQ ID NO: 37899 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aatattacagaattttatgc

SEQ ID NO: 37900 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggaaaatgacccaaaatttt

SEQ ID NO: 37901 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaatgacccaaaattttaag

SEQ ID NO: 37902 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatgacccaaaattttaagc

SEQ ID NO: 37903 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgacccaaaattttaagca

SEQ ID NO: 37904 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caacctcataaaatccactc

SEQ ID NO: 37905 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tccactctggctactgtact

SEQ ID NO: 37906 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctggctactgtactgagaa

SEQ ID NO: 37907 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tactgtactgagaatagatt

SEQ ID NO: 37908 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtactgagaatagatttgg

SEQ ID NO: 37909 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgagaatagatttggaagt

SEQ ID NO: 37910 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgagaatagatttggaagtg

SEQ ID NO: 37911 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatagatttggaagtgaggc

SEQ ID NO: 37912 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atttggaagtgaggcaagaa

SEQ ID NO: 37913 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagtgaggcaagaatggatt

SEQ ID NO: 37914 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaggcaagaatggatttagt

SEQ ID NO: 37915 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggatttagtaagataaaac

SEQ ID NO: 37916 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atttagtaagataaaacaag

SEQ ID NO: 37917 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttagtaagataaaacaagt

SEQ ID NO: 37918 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggttattacattgtcttata

SEQ ID NO: 37919 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttattacattgtcttataaa

SEQ ID NO: 37920 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tattacattgtcttataaag

SEQ ID NO: 37921 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attgtcttataaagaggtta

SEQ ID NO: 37922 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgtcttataaagaggttaa

SEQ ID NO: 37923 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcttataaagaggttaaagg

SEQ ID NO: 37924 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaagaggttaaaggtggtaa

SEQ ID NO: 37925 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggttaaaggtggtaatggat

SEQ ID NO: 37926 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaggtggtaatggattggat

SEQ ID NO: 37927 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aggtggtaatggattggatt

SEQ ID NO: 37928 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tggattggattaggtgttga

SEQ ID NO: 37929 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attggattaggtgttgacag

SEQ ID NO: 37930 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggtgttgacagtggaaatt

SEQ ID NO: 37931 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtgttgacagtggaaattaa

SEQ ID NO: 37932 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgacagtggaaattaagag

SEQ ID NO: 37933 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgatgtatttacattacat

SEQ ID NO: 37934 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgatgtatttacattacatt

SEQ ID NO: 37935 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtatttacattacattagg

SEQ ID NO: 37936 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atttacattacattaggtgg

SEQ ID NO: 37937 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cattaggtggtagaatgaac

SEQ ID NO: 37938 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtggtagaatgaactggtct

SEQ ID NO: 37939 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ctggtcttggtgaataaatg

SEQ ID NO: 37940 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggtcttggtgaataaatgcg

SEQ ID NO: 37941 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtcttggtgaataaatgcgg

SEQ ID NO: 37942 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcttggtgaataaatgcgga

SEQ ID NO: 37943 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataaatgcggagggttaatg

SEQ ID NO: 37944 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaatgcggagggttaatgaa

SEQ ID NO: 37945 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatgcggagggttaatgaag

SEQ ID NO: 37946 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggagggttaatgaagaggat

SEQ ID NO: 37947 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gttaatgaagaggattagtt

SEQ ID NO: 37948 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agaggattagtttggaaaac

SEQ ID NO: 37949 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtttggaaaactggatgaa

SEQ ID NO: 37950 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttggaaaactggatgaatgg

SEQ ID NO: 37951 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaatggtggtactaatcaat

SEQ ID NO: 37952 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggtggtactaatcaatgag

SEQ ID NO: 37953 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggtggtactaatcaatgaga

SEQ ID NO: 37954 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggtactaatcaatgagaagg

SEQ ID NO: 37955 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatttatttaccatgatata

SEQ ID NO: 37956 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catgatatacagttgtccct

SEQ ID NO: 37957 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agttgtcccttagtatctgc

SEQ ID NO: 37958 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gttgtcccttagtatctgct

SEQ ID NO: 37959 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttgtcccttagtatctgctg

SEQ ID NO: 37960 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccttagtatctgctggggat

SEQ ID NO: 37961 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atctgctggggattggcttc

SEQ ID NO: 37962 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gattggcttctggactccct

SEQ ID NO: 37963 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cctgagaataccaaaatcca

SEQ ID NO: 37964 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gctcaaatctcttatacaaa

SEQ ID NO: 37965 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatctcttatacaaatggca

SEQ ID NO: 37966 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cctacacacatcctcctata

SEQ ID NO: 37967 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tacacatcacttcatttgta

SEQ ID NO: 37968 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcatttgtatggattcaatg

SEQ ID NO: 37969 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatggattcaatgtagtact

SEQ ID NO: 37970 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcaatgtagtactcagcata

SEQ ID NO: 37971 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actcagcatatggaaaattc

SEQ ID NO: 37972 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaattcaagttttgccttt

SEQ ID NO: 37973 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaattcaagttttgcctttt

SEQ ID NO: 37974 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aattcaagttttgccttttg

SEQ ID NO: 37975 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttttgccttttggggctttg

SEQ ID NO: 37976 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttccccaactatttctgatc

SEQ ID NO: 37977 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aactatttctgatccagaat

SEQ ID NO: 37978 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tccagaattggttgaatcca

SEQ ID NO: 37979 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aattggttgaatccacagat

SEQ ID NO: 37980 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatccacagatcagaaacca

SEQ ID NO: 37981 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cagatcagaaaccatggata

SEQ ID NO: 37982 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gatcagaaaccatggatatg

SEQ ID NO: 37983 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atcagaaaccatggatatgg

SEQ ID NO: 37984 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atatatatatcttccaccat

SEQ ID NO: 37985 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatatcttccaccatgagat

SEQ ID NO: 37986 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccatgagattagtattccta

SEQ ID NO: 37987 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attagtattcctatagaaaa

SEQ ID NO: 37988 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agtattcctatagaaaaaag

SEQ ID NO: 37989 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tattcctatagaaaaaagaa

SEQ ID NO: 37990 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttcctatagaaaaaagaaga

SEQ ID NO: 37991 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atagaaaaaagaagagagac

SEQ ID NO: 37992 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaaaaaagaagagagacca

SEQ ID NO: 37993 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctcactgcctcctccatttg

SEQ ID NO: 37994 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcctcctccatttgaagaca

SEQ ID NO: 37995 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cctccatttgaagacacagt

SEQ ID NO: 37996 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtgagaatgctgccctctgc

SEQ ID NO: 37997 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaatgctgccctctgccagc

SEQ ID NO: 37998 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatgctgccctctgccagcc

SEQ ID NO: 37999 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccctctgccagccaggaaat

SEQ ID NO: 38000 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gccaggaaatgagccctcac

SEQ ID NO: 38001 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccaggaaatgagccctcact

SEQ ID NO: 38002 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caggaaatgagccctcactg

SEQ ID NO: 38003 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccctcactggggaacgaaat

SEQ ID NO: 38004 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cactggggaacgaaattggc

SEQ ID NO: 38005 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attggctggcgccttaatct

SEQ ID NO: 38006 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cgccttaatcttggactcct

SEQ ID NO: 38007 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aatcttggactcctcagcct

SEQ ID NO: 38008 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atcttggactcctcagcctc

SEQ ID NO: 38009 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcctcagcctcgggaactgt

SEQ ID NO: 38010 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaaataaatttctgttgttc

SEQ ID NO: 38011 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttctgttgttctagccacc

SEQ ID NO: 38012 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgttctagccacccagtcta

SEQ ID NO: 38013 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctatggtatattattatga

SEQ ID NO: 38014 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtatattattatgacagccc

SEQ ID NO: 38015 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatgacagccccagctttct

SEQ ID NO: 38016 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acacaaaaatgataatactc

SEQ ID NO: 38017 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctggctcctgctattgcttt

SEQ ID NO: 38018 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tattattatctctgactcct

SEQ ID NO: 38019 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgagtctcatgtcttctgc

SEQ ID NO: 38020 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcaagcatgtaacatgcta

SEQ ID NO: 38021 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagtgaattatgttactct

SEQ ID NO: 38022 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtgaattatgttactctaa

SEQ ID NO: 38023 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttccttaaatgtattgaca

SEQ ID NO: 38024 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgttccaaatgaaacgttt

SEQ ID NO: 38025 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttccaaatgaaacgttttag

SEQ ID NO: 38026 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttttagaagacatttgctg

SEQ ID NO: 38027 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acatttgctgtagattctct

SEQ ID NO: 38028 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttctcttggcctacatttta

SEQ ID NO: 38029 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctcttggcctacattttaa

SEQ ID NO: 38030 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggcctacattttaaaggcat

SEQ ID NO: 38031 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctacattttaaaggcatgag

SEQ ID NO: 38032 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tacattttaaaggcatgagt

SEQ ID NO: 38033 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttaaaggcatgagtgggac

SEQ ID NO: 38034 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgagtgggacaagtatactt

SEQ ID NO: 38035 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttcagattctctttgacttt

SEQ ID NO: 38036 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgactttgagaaaattactt

SEQ ID NO: 38037 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttaagattgcccattttctt

SEQ ID NO: 38038 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgcccattttctttggcttc

SEQ ID NO: 38039 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcccattttctttggcttct

SEQ ID NO: 38040 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcttctgggtaaaaatttgt

SEQ ID NO: 38041 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttctgggtaaaaatttgta

SEQ ID NO: 38042 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatttgtaaggtgctttgcc

SEQ ID NO: 38043 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaggtgctttgccaagaat

SEQ ID NO: 38044 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaggtgctttgccaagaata

SEQ ID NO: 38045 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caagaataaggtgcactgaa

SEQ ID NO: 38046 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cactgaatggtaaacacgat

SEQ ID NO: 38047 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actgaatggtaaacacgatt

SEQ ID NO: 38048 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatggtaaacacgattagga

SEQ ID NO: 38049 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacacgattaggatagtcaa

SEQ ID NO: 38050 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acacgattaggatagtcaac

SEQ ID NO: 38051 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cacgattaggatagtcaaca

SEQ ID NO: 38052 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cgattaggatagtcaacagg

SEQ ID NO: 38053 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gattaggatagtcaacaggg

SEQ ID NO: 38054 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcctcctttaaatttttgat

SEQ ID NO: 38055 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttaacatttgctttctacat

SEQ ID NO: 38056 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ctttctacatcagtcttttg

SEQ ID NO: 38057 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttctacatcagtcttttgc

SEQ ID NO: 38058 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tacatcagtcttttgcgggc

SEQ ID NO: 38059 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagtcttttgcgggcgagat

SEQ ID NO: 38060 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtgtgccaaactgtctcac

SEQ ID NO: 38061 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tccctctctttttacctcca

SEQ ID NO: 38062 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttacctccacagtctgtat

SEQ ID NO: 38063 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acagtctgtatgagccattg

SEQ ID NO: 38064 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtttgataaaataacctttc

SEQ ID NO: 38065 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgataaaataacctttctag

SEQ ID NO: 38066 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctgtatttctaccttaaca

SEQ ID NO: 38067 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctaccttaacatggtacat

SEQ ID NO: 38068 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taacatggtacattggaaaa

SEQ ID NO: 38069 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aacatggtacattggaaaac

SEQ ID NO: 38070 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
catggtacattggaaaacag

SEQ ID NO: 38071 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtaacaaatgatcacaaatt

SEQ ID NO: 38072 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acaaatgatcacaaatttag

SEQ ID NO: 38073 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tattatctcacaatttttgt

SEQ ID NO: 38074 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attatctcacaatttttgtg

SEQ ID NO: 38075 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atctcacaatttttgtgagg

SEQ ID NO: 38076 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctcacaatttttgtgaggc

SEQ ID NO: 38077 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcacaatttttgtgaggcag

SEQ ID NO: 38078 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atttttgtgaggcaggagcc

SEQ ID NO: 38079 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttttgtgaggcaggagcct

SEQ ID NO: 38080 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtgaggcaggagcctgggta

SEQ ID NO: 38081 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agttatctgtgttttgtata

SEQ ID NO: 38082 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acttattttttctgttctgt

SEQ ID NO: 38083 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tattttttctgttctgttag

SEQ ID NO: 38084 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attttttctgttctgttaga

SEQ ID NO: 38085 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctgttctgttagaaggaat

SEQ ID NO: 38086 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tagaaggaattagtgtatca

SEQ ID NO: 38087 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aggaattagtgtatcacagt

SEQ ID NO: 38088 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttatatccttttcttatat

SEQ ID NO: 38089 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatccttttcttatatgagc

SEQ ID NO: 38090 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attctttctcatataaaaat

SEQ ID NO: 38091 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctttctcatataaaaatgag

SEQ ID NO: 38092 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tataaaaatgagcagttctc

SEQ ID NO: 38093 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taaaaatgagcagttctcaa

SEQ ID NO: 38094 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatgagcagttctcaagag

SEQ ID NO: 38095 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcagttctcaagagtagcct

SEQ ID NO: 38096 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctcaagagtagcctaagaa

SEQ ID NO: 38097 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctcaagagtagcctaagaac

SEQ ID NO: 38098 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caagagtagcctaagaacag

SEQ ID NO: 38099 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agtagcctaagaacaggaga

SEQ ID NO: 38100 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttaacatattgtcaatgta

SEQ ID NO: 38101 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taacatattgtcaatgtaca

SEQ ID NO: 38102 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catattgtcaatgtacagag

SEQ ID NO: 38103 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attgtcaatgtacagagtag

SEQ ID NO: 38104 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgtacagagtagaagacac

SEQ ID NO: 38105 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagaagacacaagatattta

SEQ ID NO: 38106 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaagacacaagatatttaaa

SEQ ID NO: 38107 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agacacaagatatttaaaga

SEQ ID NO: 38108 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atatttaaagagagtaaatc

SEQ ID NO: 38109 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atttaaagagagtaaatctg

SEQ ID NO: 38110 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttaaagagagtaaatctgg

SEQ ID NO: 38111 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagtaaatctggaggctcct

SEQ ID NO: 38112 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atctggaggctcctcagatg

SEQ ID NO: 38113 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctggaggctcctcagatga

SEQ ID NO: 38114 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctggaggctcctcagatgaa

SEQ ID NO: 38115 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aggctcctcagatgaagggc

SEQ ID NO: 38116 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcagatgaagggccagccat

SEQ ID NO: 38117 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaagggccagccataagtaa

SEQ ID NO: 38118 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaagaatgtatttgttta

SEQ ID NO: 38119 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagaatgtatttgtttaaag

SEQ ID NO: 38120 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaagcagcacatgcaaatc

SEQ ID NO: 38121 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agattatgttctcacatatt

SEQ ID NO: 38122 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgttctcacatatttagaaa

SEQ ID NO: 38123 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atttagaaatagtaatttaa

SEQ ID NO: 38124 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttagaaatagtaatttaat

SEQ ID NO: 38125 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tagaaatagtaatttaatgg

SEQ ID NO: 38126 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtgtattcttaatattcac

SEQ ID NO: 38127 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaataaaaatgaattatga

SEQ ID NO: 38128 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatgaattatgatggtatat

SEQ ID NO: 38129 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgaattatgatggtatatta

SEQ ID NO: 38130 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attatgatggtatattagag

SEQ ID NO: 38131 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agagaagaattatattttta

SEQ ID NO: 38132 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagaattatatttttataga

SEQ ID NO: 38133 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatatgactgaactaacttg

SEQ ID NO: 38134 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttgaagacatattgttttg

SEQ ID NO: 38135 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgaagacatattgttttgt

SEQ ID NO: 38136 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtaggaaataaaataaaaac

SEQ ID NO: 38137 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taggaaataaaataaaaact

SEQ ID NO: 38138 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaataaaaactaggtcatgc

SEQ ID NO: 38139 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acttacgaataacttttgct

SEQ ID NO: 38140 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taacttttgctcagttctac

SEQ ID NO: 38141 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agatttgcaaaatttttaac

SEQ ID NO: 38142 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcttttatcttttgtttcta

SEQ ID NO: 38143 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttctaaagatatatttaaa

SEQ ID NO: 38144 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agatatatttaaaaagattc

SEQ ID NO: 38145 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atttaaaaagattcaagcta

SEQ ID NO: 38146 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caagctaaagtgcaatgatg

SEQ ID NO: 38147 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcttcaaattaccttttcg

SEQ ID NO: 38148 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcaaattaccttttcgcaga

SEQ ID NO: 38149 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agacagatcaattattaatg

SEQ ID NO: 38150 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gacagatcaattattaatgt

SEQ ID NO: 38151 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atcaattattaatgtaggta

SEQ ID NO: 38152 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attaatgtaggtatggctcg

SEQ ID NO: 38153 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taatgtaggtatggctcgca

SEQ ID NO: 38154 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aggtatggctcgcagagtaa

SEQ ID NO: 38155 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggtatggctcgcagagtaat

SEQ ID NO: 38156 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtatggctcgcagagtaata

SEQ ID NO: 38157 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atggctcgcagagtaatagg

SEQ ID NO: 38158 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcgcagagtaatagggagtc

SEQ ID NO: 38159 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagtaatagggagtcaagct

SEQ ID NO: 38160 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atagggagtcaagctaagtg

SEQ ID NO: 38161 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcaagctaagtgtagcatgt

SEQ ID NO: 38162 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtgtgcatcaaatactattg

SEQ ID NO: 38163 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagcaaaatcccctctgctc

SEQ ID NO: 38164 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaatcccctctgctctagc

SEQ ID NO: 38165 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgtaatttctccctccctt

SEQ ID NO: 38166 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtaatttctccctcccttga

SEQ ID NO: 38167 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatttctccctcccttgaga

SEQ ID NO: 38168 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agagattaccatgtatcctg

SEQ ID NO: 38169 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atcctgcagctcattttgct

SEQ ID NO: 38170 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcctgcagctcattttgctt

SEQ ID NO: 38171 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agctcattttgcttgggtta

SEQ ID NO: 38172 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attttgcttgggttatggca

SEQ ID NO: 38173 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagcattatctacaatgtga

SEQ ID NO: 38174 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atctacaatgtgaaagaatt

SEQ ID NO: 38175 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cacaatcacttatgttgaaa

SEQ ID NO: 38176 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acttatgttgaaatggatta

SEQ ID NO: 38177 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaatggattacagtattatt

SEQ ID NO: 38178 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtgattataattctattttg

SEQ ID NO: 38179 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gattataattctattttgca

SEQ ID NO: 38180 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tataattctattttgcagag

SEQ ID NO: 38181 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agagtggctattgcaactat

SEQ ID NO: 38182 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tattgcaactatcagtacaa

SEQ ID NO: 38183 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actatcagtacaaaagtccc

SEQ ID NO: 38184 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctatcagtacaaaagtccca

SEQ ID NO: 38185 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacaccttttacatgctatt

SEQ ID NO: 38186 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgctattaagataacataa

SEQ ID NO: 38187 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taacataaaagttgaaataa

SEQ ID NO: 38188 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaaagttgaaataatggcc

SEQ ID NO: 38189 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gttgaaataatggcctagta

SEQ ID NO: 38190 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cctagtatggcaattatttt

SEQ ID NO: 38191 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcttacctaatgaccatcaa

SEQ ID NO: 38192 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttacctaatgaccatcaac

SEQ ID NO: 38193 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcaacaggacttgatgctta

SEQ ID NO: 38194 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggacttgatgcttatagcta

SEQ ID NO: 38195 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttgatgcttatagctaaag

SEQ ID NO: 38196 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgatgcttatagctaaagta

SEQ ID NO: 38197 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gatgcttatagctaaagtag

SEQ ID NO: 38198 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgcttatagctaaagtaga

SEQ ID NO: 38199 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agagggttgtattaattact

SEQ ID NO: 38200 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attaattactcagctaaaaa

SEQ ID NO: 38201 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attactcagctaaaaatggt

SEQ ID NO: 38202 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taagaaccacctccactttt

SEQ ID NO: 38203 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cacctccactttttggaaat

SEQ ID NO: 38204 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tccactttttggaaataagc

SEQ ID NO: 38205 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttgaattcataaatctcaa

SEQ ID NO: 38206 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaattcataaatctcaaaag

SEQ ID NO: 38207 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagctaaattttgaaatatt

SEQ ID NO: 38208 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaatatttactacctaccaa

SEQ ID NO: 38209 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aatatttactacctaccaat

SEQ ID NO: 38210 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgggtgcataaaactcttt

SEQ ID NO: 38211 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgggtgcataaaactctttt

SEQ ID NO: 38212 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaaactcttttgggcacta

SEQ ID NO: 38213 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttatacttacccatataaaa

SEQ ID NO: 38214 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atacttacccatataaaata

SEQ ID NO: 38215 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtcattatttaacattcatg

SEQ ID NO: 38216 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cattatttaacattcatgaa

SEQ ID NO: 38217 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgcattgttcctgtatgata

SEQ ID NO: 38218 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cattgttcctgtatgataca

SEQ ID NO: 38219 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attgttcctgtatgatacag

SEQ ID NO: 38220 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttcctgtatgatacagagg

SEQ ID NO: 38221 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtatgatacagaggtagcc

SEQ ID NO: 38222 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtatgatacagaggtagcct

SEQ ID NO: 38223 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agcctgggttcttacatttt

SEQ ID NO: 38224 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgggttcttacatttttag

SEQ ID NO: 38225 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ataaattttcaatgtgtttt

SEQ ID NO: 38226 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attgttttaatttcttcatg

SEQ ID NO: 38227 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atcattacaaccacataatg

SEQ ID NO: 38228 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attacaaccacataatgaag

SEQ ID NO: 38229 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtactcttctcctcatttta

SEQ ID NO: 38230 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttctcctcattttatagat

SEQ ID NO: 38231 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcctcattttatagataaga

SEQ ID NO: 38232 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attttatagataagaaagtt

SEQ ID NO: 38233 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttttatagataagaaagttg

SEQ ID NO: 38234 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taagaaagttgaggcccata

SEQ ID NO: 38235 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagaaagttgaggcccatat

SEQ ID NO: 38236 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttgaggcccatataggtta

SEQ ID NO: 38237 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tataggttaaagaatgtatt

SEQ ID NO: 38238 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaatgtattcagcaaactca

SEQ ID NO: 38239 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatgtattcagcaaactcat

SEQ ID NO: 38240 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgtattcagcaaactcata

SEQ ID NO: 38241 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcagcaaactcatagggtca

SEQ ID NO: 38242 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcatagggtcatggcttaac

SEQ ID NO: 38243 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
catagggtcatggcttaact

SEQ ID NO: 38244 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcttaactgggatacaaata

SEQ ID NO: 38245 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgggatacaaatatagttc

SEQ ID NO: 38246 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacaaatatagttctagtct

SEQ ID NO: 38247 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtcttagaacccatgctct

SEQ ID NO: 38248 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtatgctatatcacctctt

SEQ ID NO: 38249 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatgctatatcacctcttaa

SEQ ID NO: 38250 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctatatcacctcttaagagc

SEQ ID NO: 38251 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcacctcttaagagctggta

SEQ ID NO: 38252 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agctttcccatctgtaaaat

SEQ ID NO: 38253 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cccatctgtaaaatgagaaa

SEQ ID NO: 38254 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
catctgtaaaatgagaaaaa

SEQ ID NO: 38255 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaaagagtaatactccatg

SEQ ID NO: 38256 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtaatactccatgtggttgt

SEQ ID NO: 38257 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taatactccatgtggttgta

SEQ ID NO: 38258 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aatactccatgtggttgtaa

SEQ ID NO: 38259 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
actccatgtggttgtaaggg

SEQ ID NO: 38260 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtggttgtaagggtagaat

SEQ ID NO: 38261 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgtaagggtagaatgagac

SEQ ID NO: 38262 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaatgagacaagctacaca

SEQ ID NO: 38263 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gacaagctacacaaagaaat

SEQ ID NO: 38264 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaattagaacaatgacaata

SEQ ID NO: 38265 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacaatgacaatacagaatc

SEQ ID NO: 38266 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acagaatcaagaatttatat

SEQ ID NO: 38267 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaatcaagaatttatattag

SEQ ID NO: 38268 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agaatttatattagtagtaa

SEQ ID NO: 38269 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atttatattagtagtaatag

SEQ ID NO: 38270 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atattagtagtaatagtagt

SEQ ID NO: 38271 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caatttgctactaaaaatgt

SEQ ID NO: 38272 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctactaaaaatgtaagaatc

SEQ ID NO: 38273 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tactaaaaatgtaagaatcc

SEQ ID NO: 38274 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caggctacttctgtgtcata

SEQ ID NO: 38275 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aggctacttctgtgtcatac

SEQ ID NO: 38276 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtgtcatacaggaacaatg

SEQ ID NO: 38277 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgcagtctccatgaacca

SEQ ID NO: 38278 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctccatgaaccaaagctct

SEQ ID NO: 38279 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatgctattacacaaaaatg

SEQ ID NO: 38280 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaatgtagacatcgctgtg

SEQ ID NO: 38281 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtagacatcgctgtgtggc

SEQ ID NO: 38282 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cctttgcacaaaccttgatg

SEQ ID NO: 38283 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaaccttgatgtggatttc

SEQ ID NO: 38284 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggatttcaagaaattactt

SEQ ID NO: 38285 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagaaattactttggaactc

SEQ ID NO: 38286 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ttgtccttgtctttgtttcc

SEQ ID NO: 38287 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgtccttgtctttgtttccc

SEQ ID NO: 38288 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttcccgggaacacttctta

SEQ ID NO: 38289 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcccgggaacacttcttatg

SEQ ID NO: 38290 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccgggaacacttcttatgg

SEQ ID NO: 38291 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttcttatggaggacatttg

SEQ ID NO: 38292 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaagctgtcctttcaatgaa

SEQ ID NO: 38293 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagctgtcctttcaatgaaa

SEQ ID NO: 38294 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcctttcaatgaaaaggaaa

SEQ ID NO: 38295 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatgaaaaggaaaaagctat

SEQ ID NO: 38296 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atcagttgttgcaacttatt

SEQ ID NO: 38297 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccactgactttacccaccta

SEQ ID NO: 38298 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatggttattctaactgaaa

SEQ ID NO: 38299 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttgtataacttttattct

SEQ ID NO: 38300 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tagattatattacaatgtgt

SEQ ID NO: 38301 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tattacaatgtgtcagtctc

SEQ ID NO: 38302 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tataactacaatataattta

SEQ ID NO: 38303 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atggcaaactcaaacatttt

SEQ ID NO: 38304 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcaaacattttgagcattca

SEQ ID NO: 38305 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atagatctatgaaatttgta

SEQ ID NO: 38306 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtaaagaatcctatgtaaa

SEQ ID NO: 38307 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaacagctttatgatattca

SEQ ID NO: 38308 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gctatttatttattttcatg

SEQ ID NO: 38309 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattcttgattgttttcctc

SEQ ID NO: 38310 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcttgattgttttcctcaag

SEQ ID NO: 38311 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gataataacataataaacca

SEQ ID NO: 38312 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cacagatatttttaaaaaat

SEQ ID NO: 38313 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agatatttttaaaaaattgg

SEQ ID NO: 38314 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaattggtggccttcataca

SEQ ID NO: 38315 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aattggtggccttcatacat

SEQ ID NO: 38316 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcatacataggtcctaaacc

SEQ ID NO: 38317 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catacataggtcctaaaccc

SEQ ID NO: 38318 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctaaacccaggccaattccc

SEQ ID NO: 38319 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attccctggccatcctaatt

SEQ ID NO: 38320 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cctggccatcctaatttagt

SEQ ID NO: 38321 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatttagttggcccttcttt

SEQ ID NO: 38322 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctattaacatttctctgaaa

SEQ ID NO: 38323 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atttctctgaaatagctatt

SEQ ID NO: 38324 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tattttcactctttttaata

SEQ ID NO: 38325 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaactctataaaatcatgct

SEQ ID NO: 38326 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taaaatcatgctaagtattt

SEQ ID NO: 38327 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaatcatgctaagtatttt

SEQ ID NO: 38328 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gggttgtgatgttcaacaat

SEQ ID NO: 38329 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caacaatcagcatttaaaaa

SEQ ID NO: 38330 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcatttaaaaacagctcac

SEQ ID NO: 38331 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cacccaaatcttttgcaaac

SEQ ID NO: 38332 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acccaaatcttttgcaaact

SEQ ID NO: 38333 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaactaggtaactatcaaa

SEQ ID NO: 38334 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aactatcaaaaagctaaaat

SEQ ID NO: 38335 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actatcaaaaagctaaaatt

SEQ ID NO: 38336 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttctctaattttcatccga

SEQ ID NO: 38337 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gatttgtgttcaaacctgtt

SEQ ID NO: 38338 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atttgtgttcaaacctgttt

SEQ ID NO: 38339 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttgtgttcaaacctgtttg

SEQ ID NO: 38340 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gttcaaacctgtttggggca

SEQ ID NO: 38341 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caaacctgtttggggcatgg

SEQ ID NO: 38342 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtggctcatgcctgtaaccc

SEQ ID NO: 38343 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgcctgtaaccccagcatgt

SEQ ID NO: 38344 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgtaaccccagcatgttgg

SEQ ID NO: 38345 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtaaccccagcatgttggc

SEQ ID NO: 38346 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agcatgttggcaggtcatga

SEQ ID NO: 38347 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgttggcaggtcatgacag

SEQ ID NO: 38348 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgttggcaggtcatgacagt

SEQ ID NO: 38349 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catgacagtaggaacacttg

SEQ ID NO: 38350 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acagtaggaacacttgaagc

SEQ ID NO: 38351 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagtaggaacacttgaagcc

SEQ ID NO: 38352 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtaggaacacttgaagccag

SEQ ID NO: 38353 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acacttgaagccaggagttt

SEQ ID NO: 38354 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgaagccaggagtttgagac

SEQ ID NO: 38355 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccaggagtttgagactagcc

SEQ ID NO: 38356 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caggagtttgagactagcct

SEQ ID NO: 38357 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgagactagcctgggcaaca

SEQ ID NO: 38358 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actagcctgggcaacatagc

SEQ ID NO: 38359 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atctacaaaaatttaaatat

SEQ ID NO: 38360 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acaaaaatttaaatattagc

SEQ ID NO: 38361 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caaaaatttaaatattagcc

SEQ ID NO: 38362 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atttaaatattagccaggca

SEQ ID NO: 38363 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taaatattagccaggcatgg

SEQ ID NO: 38364 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggcatggtggcatgtacctg

SEQ ID NO: 38365 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtggcatgtacctgtagtct

SEQ ID NO: 38366 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tacctgtagtcttagctact

SEQ ID NO: 38367 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acctgtagtcttagctactt

SEQ ID NO: 38368 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgtagtcttagctacttgg

SEQ ID NO: 38369 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtagtcttagctacttggg

SEQ ID NO: 38370 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcttagctacttgggaggct

SEQ ID NO: 38371 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttagctacttgggaggctg

SEQ ID NO: 38372 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agctacttgggaggctgagg

SEQ ID NO: 38373 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gctacttgggaggctgaggc

SEQ ID NO: 38374 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tacttgggaggctgaggcag

SEQ ID NO: 38375 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acttgggaggctgaggcagg

SEQ ID NO: 38376 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cttgggaggctgaggcagga

SEQ ID NO: 38377 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgaggcaggagggttgctt

SEQ ID NO: 38378 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcaggagggttgcttgagcc

SEQ ID NO: 38379 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aggagggttgcttgagccca

SEQ ID NO: 38380 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggttgcttgagcccagagtt

SEQ ID NO: 38381 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gttgcttgagcccagagttg

SEQ ID NO: 38382 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgagcccagagttgaggctg

SEQ ID NO: 38383 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agcccagagttgaggctgca

SEQ ID NO: 38384 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cccagagttgaggctgcaga

SEQ ID NO: 38385 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgatcatgccattgcactc

SEQ ID NO: 38386 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catgccattgcactctagcc

SEQ ID NO: 38387 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgccattgcactctagcct

SEQ ID NO: 38388 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgcactctagcctgggtga

SEQ ID NO: 38389 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcactctagcctgggtgaca

SEQ ID NO: 38390 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctagcctgggtgacagagc

SEQ ID NO: 38391 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctgggtgacagagcgagacc

SEQ ID NO: 38392 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cgagacctggtcacttaaaa

SEQ ID NO: 38393 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tggtcacttaaaaaagtttt

SEQ ID NO: 38394 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtttgcttccattttattct

SEQ ID NO: 38395 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttccattttattctaagtt

SEQ ID NO: 38396 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttattctaagttaagttctt

SEQ ID NO: 38397 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taactgcctttctgtattgt

SEQ ID NO: 38398 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aactgcctttctgtattgtt

SEQ ID NO: 38399 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctgtattgttgggtgtaat

SEQ ID NO: 38400 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attgttgggtgtaataagtt

SEQ ID NO: 38401 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaatttaaatattaatatga

SEQ ID NO: 38402 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taatatgacagtgccttctg

SEQ ID NO: 38403 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatatgacagtgccttctga

SEQ ID NO: 38404 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atatgacagtgccttctgaa

SEQ ID NO: 38405 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttctgaagggtgaaaccat

SEQ ID NO: 38406 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggtgaaaccatcagtacaaa

SEQ ID NO: 38407 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtacaaacagtaatctaca

SEQ ID NO: 38408 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaacagtaatctacatgga

SEQ ID NO: 38409 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aacagtaatctacatggaaa

SEQ ID NO: 38410 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagtaatctacatggaaaga

SEQ ID NO: 38411 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtaatctacatggaaagag

SEQ ID NO: 38412 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagaggtctaattttacttc

SEQ ID NO: 38413 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acttcaagcttatacttaat

SEQ ID NO: 38414 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tattatttttaattgataaa

SEQ ID NO: 38415 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttaattgataaaaagtcac

SEQ ID NO: 38416 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aattgataaaaagtcacaag

SEQ ID NO: 38417 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgttattttaaaaaaaaaca

SEQ ID NO: 38418 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaaaacatagttcatgaaa

SEQ ID NO: 38419 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaaacatagttcatgaaat

SEQ ID NO: 38420 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atagttcatgaaataggaaa

SEQ ID NO: 38421 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatatatttttgaaatgct

SEQ ID NO: 38422 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatatttttgaaatgctaag

SEQ ID NO: 38423 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaattgtgttgttaacaaac

SEQ ID NO: 38424 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttttattttacataaaaac

SEQ ID NO: 38425 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttttattttacataaaaaca

SEQ ID NO: 38426 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aggcaatgtaaaaacattaa

SEQ ID NO: 38427 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttgtcttactacattatgt

SEQ ID NO: 38428 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttatgtaagtattcataatg

SEQ ID NO: 38429 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cataatgcagttatatttgt

SEQ ID NO: 38430 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tatttgtgagtttgaaataa

SEQ ID NO: 38431 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgtgagtttgaaataacgg

SEQ ID NO: 38432 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggtagattgaattcaaattt

SEQ ID NO: 38433 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtagattgaattcaaattta

SEQ ID NO: 38434 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaatgtaatatattttgta

SEQ ID NO: 38435 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaatgtaatatattttgtat

SEQ ID NO: 38436 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttatcaaaacctatttccaa

SEQ ID NO: 38437 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatcaaaacctatttccaac

SEQ ID NO: 38438 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaacctatttccaacaggct

SEQ ID NO: 38439 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cctatttccaacaggcttgg

SEQ ID NO: 38440 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctatttccaacaggcttggt

SEQ ID NO: 38441 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgtgataaaatgatctatg

SEQ ID NO: 38442 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
taaaatgatctatgtagtct

SEQ ID NO: 38443 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagtctcggaaaacactgca

SEQ ID NO: 38444 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtctttcatattaaattaaa

SEQ ID NO: 38445 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttcatattaaattaaaaag

SEQ ID NO: 38446 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaattaaaaagtggttcaaa

SEQ ID NO: 38447 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaagtggttcaaatagcct

SEQ ID NO: 38448 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcctaagatgaatgaacct

SEQ ID NO: 38449 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taagatgaatgaacctaaga

SEQ ID NO: 38450 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgaacctaagatggtata

SEQ ID NO: 38451 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagatggtataaagaatctt

SEQ ID NO: 38452 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtataaagaatctttagccc

SEQ ID NO: 38453 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaatctttagccctagatt

SEQ ID NO: 38454 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cctagattgagttttatacg

SEQ ID NO: 38455 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attgagttttatacgtagat

SEQ ID NO: 38456 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgagttttatacgtagatt

SEQ ID NO: 38457 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agattaggacaaatgtctca

SEQ ID NO: 38458 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
caaatgtctcaaagtaataa

SEQ ID NO: 38459 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atcacaatttaaaaacattc

SEQ ID NO: 38460 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
accataaatctttgtttcta

SEQ ID NO: 38461 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccataaatctttgtttctat

SEQ ID NO: 38462 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cctctttctttttaaattgc

SEQ ID NO: 38463 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatttattattttttaaata

SEQ ID NO: 38464 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tattattttttaaatatgga

SEQ ID NO: 38465 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttaaatatggaaagcaaat

SEQ ID NO: 38466 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatggaaagcaaattagtga

SEQ ID NO: 38467 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acctcccacaaaaatcttct

SEQ ID NO: 38468 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaactacattctacctgtg

SEQ ID NO: 38469 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cctgtgcatgaataacttta

SEQ ID NO: 38470 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgcatgaataactttatag

SEQ ID NO: 38471 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgaataactttatagaaga

SEQ ID NO: 38472 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaaataaactcacgaaaaa

SEQ ID NO: 38473 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
actcacgaaaaaaagcatta

SEQ ID NO: 38474 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcttttcaaattactattaa

SEQ ID NO: 38475 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttttcaaattactattaat

SEQ ID NO: 38476 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aataggtgttttcaaaaaac

SEQ ID NO: 38477 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcaaaaaactagatgtcta

SEQ ID NO: 38478 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgaatatgtgcttgataaat

SEQ ID NO: 38479 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatgtgcttgataaattag

SEQ ID NO: 38480 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cttgataaattagaagccca

SEQ ID NO: 38481 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cccatggtactgtgttgatt

SEQ ID NO: 38482 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccatggtactgtgttgattg

SEQ ID NO: 38483 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcaaaatatatttcacatca

SEQ ID NO: 38484 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atttcacatcatagaatttt

SEQ ID NO: 38485 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttcacatcatagaatttta

SEQ ID NO: 38486 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcacatcatagaattttaag

SEQ ID NO: 38487 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catcatagaattttaaggag

SEQ ID NO: 38488 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atcatagaattttaaggaga

SEQ ID NO: 38489 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttcctcattgtatacattg

SEQ ID NO: 38490 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acattgaagtatatccaaaa

SEQ ID NO: 38491 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaagattacttccataatt

SEQ ID NO: 38492 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaagattacttccataattt

SEQ ID NO: 38493 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attacttccataatttagga

SEQ ID NO: 38494 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttccataatttaggaaagt

SEQ ID NO: 38495 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cataatttaggaaagtaagt

SEQ ID NO: 38496 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatttaggaaagtaagttgg

SEQ ID NO: 38497 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taggaaagtaagttggtggc

SEQ ID NO: 38498 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggaaagtaagttggtggcaa

SEQ ID NO: 38499 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaagtaagttggtggcaaga

SEQ ID NO: 38500 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taagttggtggcaagagagc

SEQ ID NO: 38501 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttggtggcaagagagcaagt

SEQ ID NO: 38502 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggcaagagagcaagttggc

SEQ ID NO: 38503 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actaaacacatatctgtgta

SEQ ID NO: 38504 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtcatattacatgatttga

SEQ ID NO: 38505 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
atttgaaagcttgccaaaca

SEQ ID NO: 38506 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttgaaagcttgccaaacac

SEQ ID NO: 38507 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccaaacacgggattgtatac

SEQ ID NO: 38508 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgcaataaatactgtgccc

SEQ ID NO: 38509 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcccaagttattatctgctc

SEQ ID NO: 38510 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atctgctcaagtatgtaccg

SEQ ID NO: 38511 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcaaacaactaactgcatat

SEQ ID NO: 38512 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caaacaactaactgcatatc

SEQ ID NO: 38513 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acaactaactgcatatcagg

SEQ ID NO: 38514 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caactaactgcatatcagga

SEQ ID NO: 38515 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gatttcatcaactttgctta

SEQ ID NO: 38516 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atcaactttgcttacagcga

SEQ ID NO: 38517 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcaactttgcttacagcgaa

SEQ ID NO: 38518 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgactaaacaatactgcat

SEQ ID NO: 38519 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctaaacaatactgcataaga

SEQ ID NO: 38520 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacaatactgcataagaaag

SEQ ID NO: 38521 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acaatactgcataagaaagc

SEQ ID NO: 38522 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagcaggaaaatttgacaa

SEQ ID NO: 38523 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agcaggaaaatttgacaaaa

SEQ ID NO: 38524 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaatttgacaaaagagttt

SEQ ID NO: 38525 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatttgacaaaagagtttaa

SEQ ID NO: 38526 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agagtttaagagactattat

SEQ ID NO: 38527 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agagactattatcagtattt

SEQ ID NO: 38528 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gagactattatcagtatttt

SEQ ID NO: 38529 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actattatcagtattttggg

SEQ ID NO: 38530 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatcagtattttgggcagca

SEQ ID NO: 38531 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgggcagcacagtcaaatgt

SEQ ID NO: 38532 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gggcagcacagtcaaatgtt

SEQ ID NO: 38533 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgttaggctatgtaaataa

SEQ ID NO: 38534 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gctatgtaaataatagcaaa

SEQ ID NO: 38535 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctgtcaataacttttttct

SEQ ID NO: 38536 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagttatctttgtttttttt

SEQ ID NO: 38537 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agttatctttgttttttttg

SEQ ID NO: 38538 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttatctttgttttttttgag

SEQ ID NO: 38539 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgaggagtgtaatatgtact

SEQ ID NO: 38540 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtacttagaataatttttc

SEQ ID NO: 38541 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaataatttttcaagttctg

SEQ ID NO: 38542 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtggttattctatgaacaaa

SEQ ID NO: 38543 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggttattctatgaacaaaa

SEQ ID NO: 38544 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggttattctatgaacaaaaa

SEQ ID NO: 38545 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgaacaaaaagggatatga

SEQ ID NO: 38546 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacaaaaagggatatgaaag

SEQ ID NO: 38547 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaagggatatgaaagaaga

SEQ ID NO: 38548 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaagggatatgaaagaagaa

SEQ ID NO: 38549 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctatgaaacacaatactcta

SEQ ID NO: 38550 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatgaaacacaatactctaa

SEQ ID NO: 38551 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaacacaatactctaaaggt

SEQ ID NO: 38552 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaggtaagtcttatccttgt

SEQ ID NO: 38553 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcttatccttgttggcatgt

SEQ ID NO: 38554 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tccttgttggcatgtgagtc

SEQ ID NO: 38555 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agatgaatgaaaaacatttg

SEQ ID NO: 38556 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaacatttgtagaaatgaa

SEQ ID NO: 38557 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tacatatatttttaatccca

SEQ ID NO: 38558 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttaatcccatggcatttta

SEQ ID NO: 38559 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttaatcccatggcattttat

SEQ ID NO: 38560 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttttataggcacatataaat

SEQ ID NO: 38561 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaattggttctgatgcaatg

SEQ ID NO: 38562 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgcaatgtagaataaattt

SEQ ID NO: 38563 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatttaagcacctcaaaata

SEQ ID NO: 38564 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacctctgtacattgataaa

SEQ ID NO: 38565 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgtacattgataaaaagtc

SEQ ID NO: 38566 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taatgtccattacttctatc

SEQ ID NO: 38567 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctatcaagcatttcattgca

SEQ ID NO: 38568 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagcatttcattgcaaagcc

SEQ ID NO: 38569 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agcatttcattgcaaagcca

SEQ ID NO: 38570 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttgttgatttccaaataa

SEQ ID NO: 38571 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tccaaataatagataaataa

SEQ ID NO: 38572 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcgtgtgttgtttatttaca

SEQ ID NO: 38573 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cgtgtgttgtttatttacat

SEQ ID NO: 38574 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtttatttacatgggaaac

SEQ ID NO: 38575 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actaattacaatcctgtgaa

SEQ ID NO: 38576 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caatcctgtgaaaagatgac

SEQ ID NO: 38577 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatcctgtgaaaagatgaca

SEQ ID NO: 38578 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cctgtgaaaagatgacaagg

SEQ ID NO: 38579 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agatgacaaggcagatgtaa

SEQ ID NO: 38580 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agatgtaaaagttttctaca

SEQ ID NO: 38581 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gctataatcaataattccta

SEQ ID NO: 38582 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tataatcaataattcctaca

SEQ ID NO: 38583 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagttctcttacgattctta

SEQ ID NO: 38584 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tacgattcttaaagaatcat

SEQ ID NO: 38585 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctaatgctgcccacctttct

SEQ ID NO: 38586 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taatgctgcccacctttctt

SEQ ID NO: 38587 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcccacctttcttaggaaat

SEQ ID NO: 38588 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccacctttcttaggaaatca

SEQ ID NO: 38589 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctttcttaggaaatcagagt

SEQ ID NO: 38590 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttagtgactgcactgccttc

SEQ ID NO: 38591 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcgagaatattttgataaa

SEQ ID NO: 38592 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcgagaatattttgataaaa

SEQ ID NO: 38593 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tattttgataaaaaggattt

SEQ ID NO: 38594 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgataaaaaggattttggca

SEQ ID NO: 38595 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttggcatagacttcctcaa

SEQ ID NO: 38596 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggcatagacttcctcaaaa

SEQ ID NO: 38597 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acacaaataaatcactttca

SEQ ID NO: 38598 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cacaaataaatcactttcac

SEQ ID NO: 38599 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaacaatatatcaaaaatg

SEQ ID NO: 38600 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgttcatatttctctttgtc

SEQ ID NO: 38601 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctttgttacactatcatatg

SEQ ID NO: 38602 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttgttacactatcatatga

SEQ ID NO: 38603 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gttacactatcatatgaagg

SEQ ID NO: 38604 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tacactatcatatgaaggtg

SEQ ID NO: 38605 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cactatcatatgaaggtgga

SEQ ID NO: 38606 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actatcatatgaaggtggag

SEQ ID NO: 38607 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atcatatgaaggtggagagg

SEQ ID NO: 38608 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atatgaaggtggagaggtgg

SEQ ID NO: 38609 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggtggagaggtggtggatg

SEQ ID NO: 38610 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggagaggtggtggatgaag

SEQ ID NO: 38611 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaagtggcatctgttttttc

SEQ ID NO: 38612 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
catctgttttttctggactt

SEQ ID NO: 38613 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttctcattaacattatcaa

SEQ ID NO: 38614 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaagccatatcttttttatt

SEQ ID NO: 38615 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatttttgacattttgcctt

SEQ ID NO: 38616 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ttttgacattttgccttaag

SEQ ID NO: 38617 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccttaagcggtaacgtctat

SEQ ID NO: 38618 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctataagcacgctgaatga

SEQ ID NO: 38619 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ataagcacgctgaatgacag

SEQ ID NO: 38620 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agcacgctgaatgacagtag

SEQ ID NO: 38621 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acatcctcttgtttccgttt

SEQ ID NO: 38622 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctcttgtttccgttttagtg

SEQ ID NO: 38623 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccgttttagtgtggttgtga

SEQ ID NO: 38624 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cgttttagtgtggttgtgat

SEQ ID NO: 38625 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtgtggttgtgatgggttca

SEQ ID NO: 38626 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtggttgtgatgggttcat

SEQ ID NO: 38627 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gatgggttcataggacactt

SEQ ID NO: 38628 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gggttcataggacactttgg

SEQ ID NO: 38629 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggttcataggacactttgga

SEQ ID NO: 38630 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggacactttggaaggatttg

SEQ ID NO: 38631 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctttcttccatctgtgaacg

SEQ ID NO: 38632 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttcttccatctgtgaacgaa

SEQ ID NO: 38633 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acccaaaacacgctttgtaa

SEQ ID NO: 38634 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cacgctttgtaaaagcaaat

SEQ ID NO: 38635 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtaaaagcaaataagatgtc

SEQ ID NO: 38636 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caaataagatgtcaagacaa

SEQ ID NO: 38637 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
agatgtcaagacaatggatc

SEQ ID NO: 38638 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gatccggtcaccactaacca

SEQ ID NO: 38639 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atccggtcaccactaaccat

SEQ ID NO: 38640 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cggtcaccactaaccatggg

SEQ ID NO: 38641 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
actaaccatgggcagatcca

SEQ ID NO: 38642 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgggcagatccatggcaat

SEQ ID NO: 38643 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcagatccatggcaatgagc

SEQ ID NO: 38644 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggcaatgagctggactttgt

SEQ ID NO: 38645 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcaatgagctggactttgtt

SEQ ID NO: 38646 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
actttgttgggttttgctat

SEQ ID NO: 38647 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgttgggttttgctatgag

SEQ ID NO: 38648 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gttgggttttgctatgagaa

SEQ ID NO: 38649 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgggttttgctatgagaag

SEQ ID NO: 38650 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gggttttgctatgagaagag

SEQ ID NO: 38651 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggttttgctatgagaagagg

SEQ ID NO: 38652 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gctatgagaagaggaggatc

SEQ ID NO: 38653 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctatgagaagaggaggatcc

SEQ ID NO: 38654 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tatgagaagaggaggatcca

SEQ ID NO: 38655 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagaagaggaggatccaggg

SEQ ID NO: 38656 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atccagggcagctgcaaaat

SEQ ID NO: 38657 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccagggcagctgcaaaatca

SEQ ID NO: 38658 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agggcagctgcaaaatcaga

SEQ ID NO: 38659 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agctgcaaaatcagagagtt

SEQ ID NO: 38660 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgcaaaatcagagagttta

SEQ ID NO: 38661 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtttagagaactctataaac

SEQ ID NO: 38662 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttagagaactctataaact

SEQ ID NO: 38663 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ctctataaactgggtcgcat

SEQ ID NO: 38664 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tctataaactgggtcgcatc

SEQ ID NO: 38665 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caaacttctcccaaacctca

SEQ ID NO: 38666 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaacctcatagaacatctca

SEQ ID NO: 38667 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atctcaaagtcatcctcact

SEQ ID NO: 38668 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctcaaagtcatcctcactca

SEQ ID NO: 38669 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcaaagtcatcctcactcag

SEQ ID NO: 38670 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtcatcctcactcagaggtt

SEQ ID NO: 38671 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagaggttcagtactttctt

SEQ ID NO: 38672 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aggttcagtactttcttcag

SEQ ID NO: 38673 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtggcaacactaaaattctc

SEQ ID NO: 38674 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgtacatgttcaccacaac

SEQ ID NO: 38675 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtacatgttcaccacaacc

SEQ ID NO: 38676 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acatgttcaccacaaccagg

SEQ ID NO: 38677 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catgttcaccacaaccagga

SEQ ID NO: 38678 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatgatgatataactaaca

SEQ ID NO: 38679 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgatgatataactaacaaag

SEQ ID NO: 38680 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacaaagtagaatattccaa

SEQ ID NO: 38681 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagtagaatattccaacaga

SEQ ID NO: 38682 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agtagaatattccaacagat

SEQ ID NO: 38683 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttccaacagatgggttacca

SEQ ID NO: 38684 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtctccttcaactgaacttc

SEQ ID NO: 38685 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctccttcaactgaacttcc

SEQ ID NO: 38686 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cttccaggatgaactttttt

SEQ ID NO: 38687 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttccaggatgaacttttttt

SEQ ID NO: 38688 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gatgaactttttttgggtca

SEQ ID NO: 38689 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aactttttttgggtcacagt

SEQ ID NO: 38690 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
actttttttgggtcacagtc

SEQ ID NO: 38691 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttttttgggtcacagtcggg

SEQ ID NO: 38692 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagtcgggtggcttactgtt

SEQ ID NO: 38693 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gggtggcttactgttaagaa

SEQ ID NO: 38694 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggtggcttactgttaagaat

SEQ ID NO: 38695 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttactgttaagaataggtgc

SEQ ID NO: 38696 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taggtgctagcaatccatcc

SEQ ID NO: 38697 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgctagcaatccatcccagc

SEQ ID NO: 38698 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tagcaatccatcccagccag

SEQ ID NO: 38699 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcaatccatcccagccagca

SEQ ID NO: 38700 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caatccatcccagccagcag

SEQ ID NO: 38701 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agccagcagaggttgtaatt

SEQ ID NO: 38702 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcagaggttgtaatttggaa

SEQ ID NO: 38703 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagaggttgtaatttggaac

SEQ ID NO: 38704 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggcaaatcatactgttgcca

SEQ ID NO: 38705 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcaaatcatactgttgccaa

SEQ ID NO: 38706 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttccatcttcctttttaaca

SEQ ID NO: 38707 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tccatcttcctttttaacat

SEQ ID NO: 38708 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttcctttttaacataggca

SEQ ID NO: 38709 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctttttaacataggcaaagt

SEQ ID NO: 38710 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggcaaagttggacattcca

SEQ ID NO: 38711 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaagttggacattccaaaga

SEQ ID NO: 38712 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tggacattccaaagatggcg

SEQ ID NO: 38713 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atggcgtagatgaacatgac

SEQ ID NO: 38714 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggcgtagatgaacatgacc

SEQ ID NO: 38715 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cgtagatgaacatgaccagg

SEQ ID NO: 38716 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tagatgaacatgaccaggaa

SEQ ID NO: 38717 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgaacatgaccaggaagag

SEQ ID NO: 38718 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgaacatgaccaggaagagc

SEQ ID NO: 38719 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aacatgaccaggaagagcag

SEQ ID NO: 38720 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acatgaccaggaagagcagg

SEQ ID NO: 38721 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaggccgatgttaaacaacg

SEQ ID NO: 38722 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aggccgatgttaaacaacgc

SEQ ID NO: 38723 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccgatgttaaacaacgcagg

SEQ ID NO: 38724 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cgatgttaaacaacgcagga

SEQ ID NO: 38725 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gatgttaaacaacgcaggaa

SEQ ID NO: 38726 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cgcaggaagggacatcatca

SEQ ID NO: 38727 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaagggacatcatcaaagca

SEQ ID NO: 38728 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agggacatcatcaaagcaaa

SEQ ID NO: 38729 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gacatcatcaaagcaaagag

SEQ ID NO: 38730 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tcaaagcaaagagcagcgtg

SEQ ID NO: 38731 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atcccctttgctcctttgac

SEQ ID NO: 38732 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttgctcctttgactagacg

SEQ ID NO: 38733 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgctcctttgactagacgt

SEQ ID NO: 38734 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ctttgactagacgtaggatt

SEQ ID NO: 38735 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acgtaggattcggccaatcc

SEQ ID NO: 38736 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggattcggccaatcctggc

SEQ ID NO: 38737 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ttcggccaatcctggcaaga

SEQ ID NO: 38738 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tcctggcaagacggatcact

SEQ ID NO: 38739 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcaagacggatcactcggaa

SEQ ID NO: 38740 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caagacggatcactcggaac

SEQ ID NO: 38741 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aagacggatcactcggaaca

SEQ ID NO: 38742 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acggatcactcggaacaggg

SEQ ID NO: 38743 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cggatcactcggaacagggt

SEQ ID NO: 38744 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggatcactcggaacagggta

SEQ ID NO: 38745 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gatcactcggaacagggtag

SEQ ID NO: 38746 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaatacgtttcaatcaaat

SEQ ID NO: 38747 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacgtttcaatcaaatcagc

SEQ ID NO: 38748 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gctagaaacatacctgtatg

SEQ ID NO: 38749 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tagaaacatacctgtatgtg

SEQ ID NO: 38750 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agaaacatacctgtatgtgg

SEQ ID NO: 38751 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgtatgtggaggaaaataa

SEQ ID NO: 38752 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taatagaaataaaatattta

SEQ ID NO: 38753 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cctgaaatgatgactctaaa

SEQ ID NO: 38754 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aactcatttcttatgaattc

SEQ ID NO: 38755 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catttcttatgaattcaaga

SEQ ID NO: 38756 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttttttttttttttttttt

SEQ ID NO: 38757 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ttttttttttttttttgaga

SEQ ID NO: 38758 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttttttttttttttgagacg

SEQ ID NO: 38759 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cggagtctcgctctgtcgcc

SEQ ID NO: 38760 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggagtctcgctctgtcgccc

SEQ ID NO: 38761 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctcgctctgtcgcccaggc

SEQ ID NO: 38762 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcgctctgtcgcccaggctg

SEQ ID NO: 38763 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgtcgcccaggctggagtg

SEQ ID NO: 38764 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcgcccaggctggagtgcag

SEQ ID NO: 38765 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ggagtgcagtggcgcgatct

SEQ ID NO: 38766 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcgcgatctcggctcactgc

SEQ ID NO: 38767 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tcactgcaagctccgcctcc

SEQ ID NO: 38768 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cactgcaagctccgcctccc

SEQ ID NO: 38769 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcacgccattctcctgcct

SEQ ID NO: 38770 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttctcctgcctcagcctccc

SEQ ID NO: 38771 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcctgcctcagcctcccgag

SEQ ID NO: 38772 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcctcagcctcccgagtagc

SEQ ID NO: 38773 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctcagcctcccgagtagct

SEQ ID NO: 38774 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcccgagtagctgggacta

SEQ ID NO: 38775 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcccgagtagctgggactac

SEQ ID NO: 38776 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
caggcgcccgctaccacgcc

SEQ ID NO: 38777 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cggctaattttttgtatttt

SEQ ID NO: 38778 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctaattttttgtatttttag

SEQ ID NO: 38779 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aattttttgtatttttagta

SEQ ID NO: 38780 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ttttgtatttttagtagaga

SEQ ID NO: 38781 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttgtatttttagtagagac

SEQ ID NO: 38782 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttgtatttttagtagagacg

SEQ ID NO: 38783 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagacggggtttcaccttgt

SEQ ID NO: 38784 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cggggtttcaccttgttagc

SEQ ID NO: 38785 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggggtttcaccttgttagcc

SEQ ID NO: 38786 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttcaccttgttagccagga

SEQ ID NO: 38787 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
acctcgtgatccgcccgcct

SEQ ID NO: 38788 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccgcccgcctcggcctccca

SEQ ID NO: 38789 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcctcggcctcccaaagtgc

SEQ ID NO: 38790 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctcggcctcccaaagtgct

SEQ ID NO: 38791 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcccaaagtgctgggatta

SEQ ID NO: 38792 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcccaaagtgctgggattac

SEQ ID NO: 38793 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtgctgggattacaggcgt

SEQ ID NO: 38794 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
caggcgtgagccaccgtgcc

SEQ ID NO: 38795 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgagccaccgtgcccggcc

SEQ ID NO: 38796 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gccaccgtgcccggccaaga

SEQ ID NO: 38797 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgaatgcaattacttaaaa

SEQ ID NO: 38798 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgaatgcaattacttaaaaa

SEQ ID NO: 38799 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caattacttaaaaaaggatt

SEQ ID NO: 38800 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaggattaagaaattcca

SEQ ID NO: 38801 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaggattaagaaattccaaa

SEQ ID NO: 38802 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gacattttctcctttttact

SEQ ID NO: 38803 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctcctttttactaagttca

SEQ ID NO: 38804 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctcctttttactaagttcat

SEQ ID NO: 38805 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gccattttttccctccataa

SEQ ID NO: 38806 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataatagtgttttacatttt

SEQ ID NO: 38807 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagaatgatacctactcaca

SEQ ID NO: 38808 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cctactcacatagaaaattc

SEQ ID NO: 38809 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caataccgttaaatgctaaa

SEQ ID NO: 38810 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
actattatcaatattttttt

SEQ ID NO: 38811 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatttttttgagtatcactt

SEQ ID NO: 38812 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttcagacatttttctgtgc

SEQ ID NO: 38813 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaatgtattcatgttatat

SEQ ID NO: 38814 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacctatttatttatttttc

SEQ ID NO: 38815 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatttatttatttttcaaga

SEQ ID NO: 38816 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttatttatttttcaagaca

SEQ ID NO: 38817 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agagtcttgctctgtcgcca

SEQ ID NO: 38818 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcttgctctgtcgccaaagc

SEQ ID NO: 38819 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgctctgtcgccaaagctg

SEQ ID NO: 38820 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ctgtcgccaaagctggagtg

SEQ ID NO: 38821 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcgccaaagctggagtgcgg

SEQ ID NO: 38822 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggagtgcggtggtgtgatct

SEQ ID NO: 38823 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ctactgcaatctctgcatcc

SEQ ID NO: 38824 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tactgcaatctctgcatccc

SEQ ID NO: 38825 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cccgggatcaaatgattctc

SEQ ID NO: 38826 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atcaaatgattctccagcct

SEQ ID NO: 38827 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gattctccagcctcagcctc

SEQ ID NO: 38828 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttctccagcctcagcctcca

SEQ ID NO: 38829 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tccagcctcagcctccagag

SEQ ID NO: 38830 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcctcagcctccagagtagc

SEQ ID NO: 38831 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctcagcctccagagtagct

SEQ ID NO: 38832 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctccagagtagctgggacta

SEQ ID NO: 38833 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tccagagtagctgggactac

SEQ ID NO: 38834 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caggcatgcgccaccacacc

SEQ ID NO: 38835 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctggttaatttttgtgtttt

SEQ ID NO: 38836 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttaatttttgtgtttttgg

SEQ ID NO: 38837 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttaatttttgtgtttttggt

SEQ ID NO: 38838 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taatttttgtgtttttggta

SEQ ID NO: 38839 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ttttgtgtttttggtaggga

SEQ ID NO: 38840 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agggacggttttcaccttgt

SEQ ID NO: 38841 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acggttttcaccttgttggc

SEQ ID NO: 38842 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cggttttcaccttgttggcc

SEQ ID NO: 38843 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttcaccttgttggccaggc

SEQ ID NO: 38844 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggtctcaaacttctgacttc

SEQ ID NO: 38845 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tcaagtgatttcgcccacct

SEQ ID NO: 38846 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acctcggcctcccaatgtgc

SEQ ID NO: 38847 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctcggcctcccaatgtgct

SEQ ID NO: 38848 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctcccaatgtgctgggatta

SEQ ID NO: 38849 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcccaatgtgctgggattat

SEQ ID NO: 38850 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtgctgggattataggcgt

SEQ ID NO: 38851 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gggattataggcgtgagcca

SEQ ID NO: 38852 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taggcgtgagccacagtgcc

SEQ ID NO: 38853 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttatttactttatatgtca

SEQ ID NO: 38854 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatttactttatatgtcatg

SEQ ID NO: 38855 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tactttatatgtcatggaga

SEQ ID NO: 38856 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gacaacgaaataatttatta

SEQ ID NO: 38857 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aacgaaataatttattatag

SEQ ID NO: 38858 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctcaaaataaccacaaattg

SEQ ID NO: 38859 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aataaccacaaattgaagac

SEQ ID NO: 38860 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tactgaaatgaatatctaaa

SEQ ID NO: 38861 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctatgttctcctaattgcat

SEQ ID NO: 38862 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
actttttaataatatgttaa

SEQ ID NO: 38863 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aataatatgttaatagaact

SEQ ID NO: 38864 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ataatatgttaatagaactt

SEQ ID NO: 38865 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttaatagaacttgggtcaa

SEQ ID NO: 38866 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catactatatatactatata

SEQ ID NO: 38867 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatatactatatacagtata

SEQ ID NO: 38868 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catatacatatacatatact

SEQ ID NO: 38869 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atactaagtatacgtatata

SEQ ID NO: 38870 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtatacgtatatacagtaca

SEQ ID NO: 38871 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catagtatatgtatactata

SEQ ID NO: 38872 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tactatatagtatgtatata

SEQ ID NO: 38873 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tagtatgtatatatagcata

SEQ ID NO: 38874 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tagtatgcgtatactctata

SEQ ID NO: 38875 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cgtatactctatatagcata

SEQ ID NO: 38876 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tagtatgcatatacgctata

SEQ ID NO: 38877 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catatacgctatatagcata

SEQ ID NO: 38878 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tagtatgcatatactatata

SEQ ID NO: 38879 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgcatatactatatatagta

SEQ ID NO: 38880 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
catatactatatatagtata

SEQ ID NO: 38881 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtatgcgtatactatatata

SEQ ID NO: 38882 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cgtatactatatatatagta

SEQ ID NO: 38883 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatactatatatatagtata

SEQ ID NO: 38884 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtatgcgtatactatatata

SEQ ID NO: 38885 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cgtatactatatatatagta

SEQ ID NO: 38886 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatactatatatatagtata

SEQ ID NO: 38887 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtatgcgtatactatatata

SEQ ID NO: 38888 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cgtatactatatatatagta

SEQ ID NO: 38889 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatactatatatatagtata

SEQ ID NO: 38890 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtatgcgtatactatatata

SEQ ID NO: 38891 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cgtatactatatatatagta

SEQ ID NO: 38892 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatactatatatatagtata

SEQ ID NO: 38893 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtatgcgtatactatatata

SEQ ID NO: 38894 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cgtatactatatatatagta

SEQ ID NO: 38895 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatactatatatatagtata

SEQ ID NO: 38896 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtatgcgtatactatatata

SEQ ID NO: 38897 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cgtatactatatatatagta

SEQ ID NO: 38898 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatactatatatatagtata

SEQ ID NO: 38899 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtatgcgtatactatatata

SEQ ID NO: 38900 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cgtatactatatatatagta

SEQ ID NO: 38901 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatactatatatatagtata

SEQ ID NO: 38902 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtatagagtatgtatatata

SEQ ID NO: 38903 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catactctatactatataca

SEQ ID NO: 38904 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atatatatacacacaatata

SEQ ID NO: 38905 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatatagctgaacctatctc

SEQ ID NO: 38906 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagctgaacctatctccaga

SEQ ID NO: 38907 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtactaattaacatttctaa

SEQ ID NO: 38908 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctaattaacatttctaatgg

SEQ ID NO: 38909 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttctaatggcagtatatga

SEQ ID NO: 38910 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcatactttacacattcaa

SEQ ID NO: 38911 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttacacattcaacagtatt

SEQ ID NO: 38912 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtgctaccattcttcttta

SEQ ID NO: 38913 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgttattttgtatccttat

SEQ ID NO: 38914 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgtttttaacttctgtttt

SEQ ID NO: 38915 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttaacttctgtttttggct

SEQ ID NO: 38916 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cttctgtttttggcttagtt

SEQ ID NO: 38917 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtatttgcccatgtgtctat

SEQ ID NO: 38918 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tatttgcccatgtgtctatt

SEQ ID NO: 38919 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctatattcttattaatttat

SEQ ID NO: 38920 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taagaacaattttctattta

SEQ ID NO: 38921 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ttaaagtattgatcctttct

SEQ ID NO: 38922 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatgatgattttttcccca

SEQ ID NO: 38923 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaatattttgtttttttgtg

SEQ ID NO: 38924 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcttcttcatttttttttt

SEQ ID NO: 38925 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttacaaatttgtgttttgca

SEQ ID NO: 38926 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatttgtgttttgcataga

SEQ ID NO: 38927 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatttgtgttttgcatagaa

SEQ ID NO: 38928 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttgcatagaaaggactat

SEQ ID NO: 38929 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgcatagaaaggactataa

SEQ ID NO: 38930 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaaaggactataagagtata

SEQ ID NO: 38931 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatttccacatatttcctac

SEQ ID NO: 38932 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agaatctttttttttaactt

SEQ ID NO: 38933 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attcatgtgatcttttcaca

SEQ ID NO: 38934 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gatcttttcacacagtaaat

SEQ ID NO: 38935 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaattggtaattatacatta

SEQ ID NO: 38936 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttatacattaaagtttaatt

SEQ ID NO: 38937 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggactctcttcaaacccact

SEQ ID NO: 38938 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actgagcttttatatttgaa

SEQ ID NO: 38939 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctatatgtcttaatattttg

SEQ ID NO: 38940 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtcttaatattttgcagaat

SEQ ID NO: 38941 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgtcaccctaattttcttc

SEQ ID NO: 38942 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aattttcttccagatgaatt

SEQ ID NO: 38943 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagatgaatttagaatcatt

SEQ ID NO: 38944 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tattacccacactacataaa

SEQ ID NO: 38945 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgatattttccttgaattta

SEQ ID NO: 38946 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatagattaataaatttga

SEQ ID NO: 38947 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgaaagtcttaattacaat

SEQ ID NO: 38948 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaaagtcttaattacaatga

SEQ ID NO: 38949 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agtcttaattacaatgagag

SEQ ID NO: 38950 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acaatgagagaagcttatct

SEQ ID NO: 38951 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gacaatcctttcaattattt

SEQ ID NO: 38952 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagctttcttttatatccta

SEQ ID NO: 38953 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttatatcctaaagttttctt

SEQ ID NO: 38954 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatcctaaagttttcttcag

SEQ ID NO: 38955 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcagaagtctcatatgata

SEQ ID NO: 38956 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcatatgataaagttattat

SEQ ID NO: 38957 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttttattgcaattgtgaat

SEQ ID NO: 38958 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttctaatttttttcatgtat

SEQ ID NO: 38959 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttcatgtataagataattat

SEQ ID NO: 38960 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tataagataattattagtgt

SEQ ID NO: 38961 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
actctaattgaatttatttt

SEQ ID NO: 38962 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttctctttcaatatatgaac

SEQ ID NO: 38963 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acaagttctttcattatatg

SEQ ID NO: 38964 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agttctttcattatatgaag

SEQ ID NO: 38965 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gttctttcattatatgaaga

SEQ ID NO: 38966 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgaagaaggtcattatatt

SEQ ID NO: 38967 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgaagaaggtcattatatta

SEQ ID NO: 38968 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gttttcttatctaattgcat

SEQ ID NO: 38969 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttggccaacaacactaaaaa

SEQ ID NO: 38970 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggccaacaacactaaaaac

SEQ ID NO: 38971 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggccaacaacactaaaaaca

SEQ ID NO: 38972 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cactaaaaacagggatgata

SEQ ID NO: 38973 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actaaaaacagggatgatac

SEQ ID NO: 38974 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttttttttcctgacttaa

SEQ ID NO: 38975 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttttttttcctgacttaat

SEQ ID NO: 38976 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgacttaataggaatgcttt

SEQ ID NO: 38977 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gctttcagaatcatttttgt

SEQ ID NO: 38978 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acattttcttatatcaattt

SEQ ID NO: 38979 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atcaattttggtatgacttc

SEQ ID NO: 38980 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taaatgcttactctgttatg

SEQ ID NO: 38981 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcactcaattttatgattct

SEQ ID NO: 38982 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catgcaaccttgaacctttt

SEQ ID NO: 38983 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taacctgttgattaaacttg

SEQ ID NO: 38984 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctataatctctctctcttaa

SEQ ID NO: 38985 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaagtttataattctaaa

SEQ ID NO: 38986 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acaatcctaaaatactttgc

SEQ ID NO: 38987 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataacaacaacaacaaaaac

SEQ ID NO: 38988 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acaacaacaacaaaaacaag

SEQ ID NO: 38989 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caacaacaaaaacaagaaga

SEQ ID NO: 38990 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agaagatagaaaaacaacca

SEQ ID NO: 38991 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caaccatggcaatgaatgta

SEQ ID NO: 38992 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaccatggcaatgaatgtat

SEQ ID NO: 38993 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catggcaatgaatgtatagg

SEQ ID NO: 38994 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaatcatgtgctgttattca

SEQ ID NO: 38995 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attcacagacatgaacacca

SEQ ID NO: 38996 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acagacatgaacaccatggc

SEQ ID NO: 38997 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
catgaacaccatggctggtt

SEQ ID NO: 38998 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgaacaccatggctggttg

SEQ ID NO: 38999 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atggctggttgaggaatgat

SEQ ID NO: 39000 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggcattttatacacttgtg

SEQ ID NO: 39001 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatacacttgtgaagtatt

SEQ ID NO: 39002 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taagctgtaaaaaataaaac

SEQ ID NO: 39003 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaaataaaactggcatttc

SEQ ID NO: 39004 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaataaaactggcatttcta

SEQ ID NO: 39005 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cttaacttcactttaaattc

SEQ ID NO: 39006 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacttcactttaaattctgg

SEQ ID NO: 39007 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaagaattttcacaaattca

SEQ ID NO: 39008 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcacaaattcacagatattc

SEQ ID NO: 39009 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attatcattaatcaaatgac

SEQ ID NO: 39010 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtctcacatgtgctaaaac

SEQ ID NO: 39011 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctcacatgtgctaaaaccag

SEQ ID NO: 39012 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gctaaaaccagaagttattt

SEQ ID NO: 39013 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agttatttcagattcaacat

SEQ ID NO: 39014 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agattcaacattggttttcc

SEQ ID NO: 39015 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacattggttttccaagaca

SEQ ID NO: 39016 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gacacagctatatataaaca

SEQ ID NO: 39017 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctatatataaacatggtaac

SEQ ID NO: 39018 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acatggtaactagttttgca

SEQ ID NO: 39019 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catggtaactagttttgcaa

SEQ ID NO: 39020 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagttttgcaaaggtaatat

SEQ ID NO: 39021 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attggaaactaaatatcaac

SEQ ID NO: 39022 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caagtataatttccttctaa

SEQ ID NO: 39023 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tataatttccttctaataga

SEQ ID NO: 39024 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttctaatagatagaaatatt

SEQ ID NO: 39025 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagatagaaatatttggctt

SEQ ID NO: 39026 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agatagaaatatttggcttt

SEQ ID NO: 39027 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gatagaaatatttggctttg

SEQ ID NO: 39028 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atatttggctttggggcctg

SEQ ID NO: 39029 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tggggcctgtagtgtaaacc

SEQ ID NO: 39030 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtgtaaacccagaaacactg

SEQ ID NO: 39031 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acccagaaacactgtagtat

SEQ ID NO: 39032 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccagaaacactgtagtatga

SEQ ID NO: 39033 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaacactgtagtatgagaga

SEQ ID NO: 39034 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagatatttgttttgctttt

SEQ ID NO: 39035 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agatatttgttttgcttttt

SEQ ID NO: 39036 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcattgtactgacttactc

SEQ ID NO: 39037 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cattgtactgacttactcaa

SEQ ID NO: 39038 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcaagagtaaatttgtgttc

SEQ ID NO: 39039 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaatttgtgttcaagaatt

SEQ ID NO: 39040 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aattcagcatatacttcctt

SEQ ID NO: 39041 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcatatacttccttgagcat

SEQ ID NO: 39042 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacttccttgagcataagtg

SEQ ID NO: 39043 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccttgagcataagtgaagtt

SEQ ID NO: 39044 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ataaatattcttacctacaa

SEQ ID NO: 39045 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaatattcttacctacaatg

SEQ ID NO: 39046 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atcaaaaatattccatccta

SEQ ID NO: 39047 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatattccatcctacagtg

SEQ ID NO: 39048 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tattccatcctacagtgaag

SEQ ID NO: 39049 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tccatcctacagtgaagtag

SEQ ID NO: 39050 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acagtgaagtagtagtgtct

SEQ ID NO: 39051 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagtgaagtagtagtgtctg

SEQ ID NO: 39052 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agtgaagtagtagtgtctga

SEQ ID NO: 39053 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgaagtagtagtgtctgagg

SEQ ID NO: 39054 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tagtagtgtctgagggagat

SEQ ID NO: 39055 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtctgagggagatcagttt

SEQ ID NO: 39056 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagttttagcacacattctc

SEQ ID NO: 39057 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcacacattctccagtgaa

SEQ ID NO: 39058 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcacacattctccagtgaaa

SEQ ID NO: 39059 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atttatccaatataaaactt

SEQ ID NO: 39060 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
accctccttttctaccatca

SEQ ID NO: 39061 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
accatcatggttaccatgtt

SEQ ID NO: 39062 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcatggttaccatgttgaga

SEQ ID NO: 39063 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttaccatgttgagacagat

SEQ ID NO: 39064 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaccatgatactaatatca

SEQ ID NO: 39065 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaccatgatactaatatcaa

SEQ ID NO: 39066 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcaaaggcttgatttgtcac

SEQ ID NO: 39067 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caaaggcttgatttgtcact

SEQ ID NO: 39068 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctaggtcaaatatacatcct

SEQ ID NO: 39069 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tccttggattttgttctgca

SEQ ID NO: 39070 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attttgttctgcaaagaaat

SEQ ID NO: 39071 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aataagaataatatcgaatg

SEQ ID NO: 39072 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taagaataatatcgaatgca

SEQ ID NO: 39073 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaatgcagagtaaacttttc

SEQ ID NO: 39074 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaacttttcaagtattatc

SEQ ID NO: 39075 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caagtattatccagaaatta

SEQ ID NO: 39076 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gatgtgcattaaaaatgaat

SEQ ID NO: 39077 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atttgaaaatctatatgcta

SEQ ID NO: 39078 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatatatatttttttacccc

SEQ ID NO: 39079 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atatttttttacccctggtc

SEQ ID NO: 39080 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatttttttacccctggtcg

SEQ ID NO: 39081 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttacccctggtcgaggaat

SEQ ID NO: 39082 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggtcgaggaattggcttttg

SEQ ID NO: 39083 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aattggcttttgtggcttct

SEQ ID NO: 39084 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttttgtggcttcttggaccc

SEQ ID NO: 39085 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccagctttttcattgcatta

SEQ ID NO: 39086 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcttctgttcttctgtcata

SEQ ID NO: 39087 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataaagatgtcttgacctcc

SEQ ID NO: 39088 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taaagatgtcttgacctcca

SEQ ID NO: 39089 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgtcttgacctccaaggta

SEQ ID NO: 39090 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaacaaacaaaaaataaatg

SEQ ID NO: 39091 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaataaatgtagttaaaac

SEQ ID NO: 39092 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcattgtctacatctttcta

SEQ ID NO: 39093 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctttctatagattactaaaa

SEQ ID NO: 39094 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttctatagattactaaaat

SEQ ID NO: 39095 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taggttaaaatgtgttaata

SEQ ID NO: 39096 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtattttattatgttcatga

SEQ ID NO: 39097 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttaaataattacatatgtg

SEQ ID NO: 39098 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attacatatgtgtagaaaca

SEQ ID NO: 39099 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttacatatgtgtagaaacat

SEQ ID NO: 39100 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaaacatgggtctccaaaca

SEQ ID NO: 39101 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatttgtattacatataat

SEQ ID NO: 39102 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatttgtattacatataata

SEQ ID NO: 39103 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtattacatataataaggat

SEQ ID NO: 39104 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggattggctcaatattcttt

SEQ ID NO: 39105 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tattcttttggtgtgctaat

SEQ ID NO: 39106 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttttatcttttttatctgc

SEQ ID NO: 39107 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttactgtgacttttattgct

SEQ ID NO: 39108 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttattgctaagaaaatttgt

SEQ ID NO: 39109 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaaaatttgtaagaattaa

SEQ ID NO: 39110 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaatatcttctttgatgatt

SEQ ID NO: 39111 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgatgatttggcaaatatt

SEQ ID NO: 39112 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatatttagaacttttata

SEQ ID NO: 39113 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttagaacttttataaagaa

SEQ ID NO: 39114 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttagaacttttataaagaat

SEQ ID NO: 39115 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tagaacttttataaagaata

SEQ ID NO: 39116 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaacttttataaagaatagg

SEQ ID NO: 39117 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaatagggagccaaatcat

SEQ ID NO: 39118 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcccattcacaattactaca

SEQ ID NO: 39119 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccattcacaattactacaaa

SEQ ID NO: 39120 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacaaagagaataaaatacc

SEQ ID NO: 39121 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acaaagagaataaaatacct

SEQ ID NO: 39122 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacctaggaatccaacttac

SEQ ID NO: 39123 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acctaggaatccaacttaca

SEQ ID NO: 39124 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctaggaatccaacttacaa

SEQ ID NO: 39125 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tccaacttacaagggatgtg

SEQ ID NO: 39126 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccaacttacaagggatgtga

SEQ ID NO: 39127 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gggatgtgaaggacctcttc

SEQ ID NO: 39128 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggatgtgaaggacctcttca

SEQ ID NO: 39129 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgtgaaggacctcttcaag

SEQ ID NO: 39130 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagaactacaaaccactgct

SEQ ID NO: 39131 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
accactgctcagcgaaataa

SEQ ID NO: 39132 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cactgctcagcgaaataaaa

SEQ ID NO: 39133 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actgctcagcgaaataaaag

SEQ ID NO: 39134 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taaaagaggacacaaacaaa

SEQ ID NO: 39135 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagaggacacaaacaaatgg

SEQ ID NO: 39136 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggaagaatattccatgctca

SEQ ID NO: 39137 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaatattccatgctcatgga

SEQ ID NO: 39138 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatattccatgctcatggat

SEQ ID NO: 39139 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attccatgctcatggatagg

SEQ ID NO: 39140 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagactcaatatcatgaaaa

SEQ ID NO: 39141 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaaaatggcattactgccc

SEQ ID NO: 39142 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaaatggcattactgccca

SEQ ID NO: 39143 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattcaatgctatccccatc

SEQ ID NO: 39144 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
actgactttcttcacaaaat

SEQ ID NO: 39145 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attggaaaaaaactacttta

SEQ ID NO: 39146 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaactactttaaagttcata

SEQ ID NO: 39147 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagttcatatggaaccaaaa

SEQ ID NO: 39148 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gttcatatggaaccaaaaaa

SEQ ID NO: 39149 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaaccaaaaaagagcctgca

SEQ ID NO: 39150 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaaagagcctgcatagcc

SEQ ID NO: 39151 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcatagccaagataatcct

SEQ ID NO: 39152 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccaagataatcctaagcaaa

SEQ ID NO: 39153 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatcctaagcaaaaagaaca

SEQ ID NO: 39154 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctaagcaaaaagaacaaagc

SEQ ID NO: 39155 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagcaaaaagaacaaagctg

SEQ ID NO: 39156 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agcaaaaagaacaaagctgg

SEQ ID NO: 39157 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgacttcaaactatactac

SEQ ID NO: 39158 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgacttcaaactatactaca

SEQ ID NO: 39159 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caaactatactacaaggcta

SEQ ID NO: 39160 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caaggctacagtaaccaaaa

SEQ ID NO: 39161 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctacagtaaccaaaacagca

SEQ ID NO: 39162 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taaccaaaacagcatggtac

SEQ ID NO: 39163 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcatggtactggtaccaaaa

SEQ ID NO: 39164 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaacagatacatacaccaa

SEQ ID NO: 39165 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agatacatacaccaacagaa

SEQ ID NO: 39166 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catacaccaacagaacagaa

SEQ ID NO: 39167 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tacaccaacagaacagaaca

SEQ ID NO: 39168 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acaccaacagaacagaacag

SEQ ID NO: 39169 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acagaacagaacagaggcct

SEQ ID NO: 39170 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgacaaacctcacaaaaac

SEQ ID NO: 39171 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aacctcacaaaaacaagcaa

SEQ ID NO: 39172 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acctcacaaaaacaagcaac

SEQ ID NO: 39173 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctcacaaaaacaagcaacg

SEQ ID NO: 39174 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acaaaaacaagcaacgggga

SEQ ID NO: 39175 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caaaaacaagcaacggggaa

SEQ ID NO: 39176 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccctatttaataaatgatgc

SEQ ID NO: 39177 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctatttaataaatgatgct

SEQ ID NO: 39178 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ataaatgatgctgggaaaac

SEQ ID NO: 39179 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgatgctgggaaaactggc

SEQ ID NO: 39180 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaaaactggctagccatatg

SEQ ID NO: 39181 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actggctagccatatgtaga

SEQ ID NO: 39182 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catatgtagaaagttgaaac

SEQ ID NO: 39183 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccttgtacaaaaattaactc

SEQ ID NO: 39184 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtacaaaaattaactcaaga

SEQ ID NO: 39185 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattaactcaagatggatta

SEQ ID NO: 39186 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggattaaagacttaaatgt

SEQ ID NO: 39187 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acctaaaaccataaaaaccc

SEQ ID NO: 39188 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaaccataaaaaccctag

SEQ ID NO: 39189 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaaaccctagaagaaactc

SEQ ID NO: 39190 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaaccctagaagaaactct

SEQ ID NO: 39191 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaactctaggcaatatcatt

SEQ ID NO: 39192 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aactctaggcaatatcattc

SEQ ID NO: 39193 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aggcaatatcattcaggaca

SEQ ID NO: 39194 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggcaatatcattcaggacat

SEQ ID NO: 39195 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatcattcaggacataggca

SEQ ID NO: 39196 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atcattcaggacataggcat

SEQ ID NO: 39197 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcaggacataggcatgggca

SEQ ID NO: 39198 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttcatgactaaaacaccaa

SEQ ID NO: 39199 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gactaaaacaccaaaagcaa

SEQ ID NO: 39200 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
accaaaagcaatggcaacaa

SEQ ID NO: 39201 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatggcaacaaaagccaaaa

SEQ ID NO: 39202 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caaaagccaaaacagacaaa

SEQ ID NO: 39203 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaagccaaaacagacaaat

SEQ ID NO: 39204 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgggatctaattaaacta

SEQ ID NO: 39205 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgggatctaattaaactaaa

SEQ ID NO: 39206 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaactaaagagcttctgca

SEQ ID NO: 39207 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagagcttctgcaaagcaa

SEQ ID NO: 39208 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaagcaaaagaaactatcat

SEQ ID NO: 39209 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agcaaaagaaactatcatca

SEQ ID NO: 39210 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaaactatcatcagagtgaa

SEQ ID NO: 39211 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaactatcatcagagtgaac

SEQ ID NO: 39212 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagagtgaacaggcaaccta

SEQ ID NO: 39213 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgaacaggcaacctacagaa

SEQ ID NO: 39214 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaacaggcaacctacagaat

SEQ ID NO: 39215 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acaggcaacctacagaatgg

SEQ ID NO: 39216 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcaatttatccatctgacaa

SEQ ID NO: 39217 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caatttatccatctgacaaa

SEQ ID NO: 39218 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aatttatccatctgacaaaa

SEQ ID NO: 39219 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgacaaaagggctaatatc

SEQ ID NO: 39220 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gctaatatccagaatctaca

SEQ ID NO: 39221 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagaacttaaacaaatttac

SEQ ID NO: 39222 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaacaaacaactccatcaaa

SEQ ID NO: 39223 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caaacaactccatcaaaaag

SEQ ID NO: 39224 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaacaactccatcaaaaagt

SEQ ID NO: 39225 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actccatcaaaaagtgggca

SEQ ID NO: 39226 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctccatcaaaaagtgggcaa

SEQ ID NO: 39227 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagtgggcaaaggatatgaa

SEQ ID NO: 39228 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtgggcaaaggatatgaac

SEQ ID NO: 39229 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatgaacaggtacttctcaa

SEQ ID NO: 39230 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaacaggtacttctcaaaag

SEQ ID NO: 39231 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcaaaagaagacatttatg

SEQ ID NO: 39232 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaagacatttatgcagccaa

SEQ ID NO: 39233 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaaaaaatgctcatcatcac

SEQ ID NO: 39234 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgctcatcatcactggtcat

SEQ ID NO: 39235 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctcatcatcactggtcatca

SEQ ID NO: 39236 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acacaaatcaaaaccacaat

SEQ ID NO: 39237 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agataccacctcatgccaat

SEQ ID NO: 39238 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccacctcatgccaattagaa

SEQ ID NO: 39239 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttagaatggcaatcactaaa

SEQ ID NO: 39240 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatggcaatcactaaaaagt

SEQ ID NO: 39241 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atggcaatcactaaaaagtc

SEQ ID NO: 39242 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actaaaaagtcaggaaacaa

SEQ ID NO: 39243 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtcaggaaacaacagatgt

SEQ ID NO: 39244 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcaggaaacaacagatgttg

SEQ ID NO: 39245 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aggaaacaacagatgttgga

SEQ ID NO: 39246 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggaaacaacagatgttggag

SEQ ID NO: 39247 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aacagatgttggagaggatg

SEQ ID NO: 39248 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagatgttggagaggatgtg

SEQ ID NO: 39249 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttggagaggatgtggagaaa

SEQ ID NO: 39250 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagcaacgcttttacactgt

SEQ ID NO: 39251 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aacgcttttacactgttggt

SEQ ID NO: 39252 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cgcttttacactgttggtga

SEQ ID NO: 39253 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgttggtgagagtgtaaaa

SEQ ID NO: 39254 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtaaaatagttcaaccattg

SEQ ID NO: 39255 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatagttcaaccattgtgg

SEQ ID NO: 39256 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agttcaaccattgtggaaga

SEQ ID NO: 39257 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agacagtgtgatgattcctc

SEQ ID NO: 39258 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attcctcaagaatctaaaac

SEQ ID NO: 39259 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actagaaataccatttgacc

SEQ ID NO: 39260 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgacccagcaatctcattac

SEQ ID NO: 39261 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gacccagcaatctcattact

SEQ ID NO: 39262 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcattactgggtatatactc

SEQ ID NO: 39263 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cattactgggtatatactca

SEQ ID NO: 39264 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
attactgggtatatactcaa

SEQ ID NO: 39265 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgtaaatcatgctactata

SEQ ID NO: 39266 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgcatatgtatatttattg

SEQ ID NO: 39267 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tattgcagcactattcacaa

SEQ ID NO: 39268 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagcactattcacaatagca

SEQ ID NO: 39269 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tattcacaatagcaaagact

SEQ ID NO: 39270 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acccaaatgtccatcaataa

SEQ ID NO: 39271 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatgtccatcaataatagac

SEQ ID NO: 39272 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catcaataatagactggata

SEQ ID NO: 39273 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagactggataaagaaaatg

SEQ ID NO: 39274 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatgtggcatatatacacca

SEQ ID NO: 39275 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atacaccatggaatactatg

SEQ ID NO: 39276 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatactatgcagccataaaa

SEQ ID NO: 39277 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atactatgcagccataaaaa

SEQ ID NO: 39278 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgcagccataaaaaaggat

SEQ ID NO: 39279 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggatgagttcatgtcctttg

SEQ ID NO: 39280 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gatgagttcatgtcctttgt

SEQ ID NO: 39281 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgagttcatgtcctttgta

SEQ ID NO: 39282 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cctttgtagggacatgcatg

SEQ ID NO: 39283 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtagggacatgcatgaagc

SEQ ID NO: 39284 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagctggaaaccatcattct

SEQ ID NO: 39285 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cattctcagcaaaatatcac

SEQ ID NO: 39286 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attctcagcaaaatatcaca

SEQ ID NO: 39287 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tcagcaaaatatcacaagga

SEQ ID NO: 39288 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctctgcatgttctcactcat

SEQ ID NO: 39289 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgcatgttctcactcataag

SEQ ID NO: 39290 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcatgttctcactcataagt

SEQ ID NO: 39291 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgttctcactcataagtgg

SEQ ID NO: 39292 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ataagtgggagttgaacaat

SEQ ID NO: 39293 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agttgaacaatgagaacaca

SEQ ID NO: 39294 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acaatgagaacacatggaca

SEQ ID NO: 39295 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caatgagaacacatggacac

SEQ ID NO: 39296 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aatgagaacacatggacaca

SEQ ID NO: 39297 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgagaacacatggacacagg

SEQ ID NO: 39298 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagaacacatggacacaggg

SEQ ID NO: 39299 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agaacacatggacacaggga

SEQ ID NO: 39300 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaacacatggacacagggag

SEQ ID NO: 39301 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gggaggggaacatcacacac

SEQ ID NO: 39302 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggaggggaacatcacacacc

SEQ ID NO: 39303 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaggggaacatcacacacca

SEQ ID NO: 39304 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aggggaacatcacacaccag

SEQ ID NO: 39305 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggaacatcacacaccagggg

SEQ ID NO: 39306 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catcacacaccaggggcagt

SEQ ID NO: 39307 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atcacacaccaggggcagtt

SEQ ID NO: 39308 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcacacaccaggggcagtta

SEQ ID NO: 39309 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cacacaccaggggcagttag

SEQ ID NO: 39310 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acacaccaggggcagttagg

SEQ ID NO: 39311 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
accaggggcagttagggggt

SEQ ID NO: 39312 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccaggggcagttagggggtt

SEQ ID NO: 39313 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aggggcagttagggggttgg

SEQ ID NO: 39314 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agttagggggttgggagctt

SEQ ID NO: 39315 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gttagggggttgggagcttt

SEQ ID NO: 39316 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tagggggttgggagctttgg

SEQ ID NO: 39317 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agggggttgggagctttggg

SEQ ID NO: 39318 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gggggttgggagctttggga

SEQ ID NO: 39319 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagctttgggagggattact

SEQ ID NO: 39320 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agctttgggagggattactt

SEQ ID NO: 39321 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctttgggagggattacttag

SEQ ID NO: 39322 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaatacctaatgtaaatgat

SEQ ID NO: 39323 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatgtaaatgatgagttgat

SEQ ID NO: 39324 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaatgatgagttgattggtg

SEQ ID NO: 39325 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attggtgcagcaaaccaaca

SEQ ID NO: 39326 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catgttttgcacatgtaccc

SEQ ID NO: 39327 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cacatgtaccctagaactta

SEQ ID NO: 39328 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaaagtataataataaaaa

SEQ ID NO: 39329 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtataataataaaaaaagaa

SEQ ID NO: 39330 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tataataataaaaaaagaat

SEQ ID NO: 39331 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ataataataaaaaaagaata

SEQ ID NO: 39332 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taataataaaaaaagaatag

SEQ ID NO: 39333 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catttctatatctctatttc

SEQ ID NO: 39334 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacctttttaattctaaata

SEQ ID NO: 39335 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acctttttaattctaaataa

SEQ ID NO: 39336 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttcaacataaacactttat

SEQ ID NO: 39337 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gatgtcaacattatccttga

SEQ ID NO: 39338 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cattatccttgatagatttc

SEQ ID NO: 39339 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attatccttgatagatttct

SEQ ID NO: 39340 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgatagatttctaggtact

SEQ ID NO: 39341 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgatagatttctaggtactg

SEQ ID NO: 39342 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagatttctaggtactgagg

SEQ ID NO: 39343 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caattatcatacccaaactg

SEQ ID NO: 39344 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aattatcatacccaaactga

SEQ ID NO: 39345 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctttccaattgattacataa

SEQ ID NO: 39346 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atataacttttaaaattcaa

SEQ ID NO: 39347 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaataacataacatctaaat

SEQ ID NO: 39348 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aataacataacatctaaatg

SEQ ID NO: 39349 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atctaaatgaggtttttgac

SEQ ID NO: 39350 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgaggtttttgactggaa

SEQ ID NO: 39351 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggaaaagcctaaatcttaca

SEQ ID NO: 39352 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaaagcctaaatcttacaa

SEQ ID NO: 39353 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaagcctaaatcttacaaa

SEQ ID NO: 39354 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaagcctaaatcttacaaag

SEQ ID NO: 39355 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aagcctaaatcttacaaagg

SEQ ID NO: 39356 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agcctaaatcttacaaaggg

SEQ ID NO: 39357 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaatcttacaaaggggggc

SEQ ID NO: 39358 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atcttacaaaggggggctag

SEQ ID NO: 39359 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caaaggggggctagaagctt

SEQ ID NO: 39360 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgttctctgctaatttctt

SEQ ID NO: 39361 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctctgctaatttcttaagt

SEQ ID NO: 39362 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taatttcttaagttagctgt

SEQ ID NO: 39363 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taagttagctgtaagtttta

SEQ ID NO: 39364 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gatttatgtatattctacat

SEQ ID NO: 39365 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtctataatttcaccttttt

SEQ ID NO: 39366 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatttcacctttttaagtca

SEQ ID NO: 39367 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttaagtcacagcataaat

SEQ ID NO: 39368 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttagtataatccatataatt

SEQ ID NO: 39369 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataattaagaatttattttc

SEQ ID NO: 39370 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taattaagaatttattttca

SEQ ID NO: 39371 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatttattttcaaggattta

SEQ ID NO: 39372 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttcaaggatttatagttct

SEQ ID NO: 39373 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgagatcattacttaacttg

SEQ ID NO: 39374 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagatcattacttaacttgt

SEQ ID NO: 39375 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agatcattacttaacttgta

SEQ ID NO: 39376 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttacttaacttgtagggtgc

SEQ ID NO: 39377 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttgtagggtgctggaatta

SEQ ID NO: 39378 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgctggaattaaagatgacc

SEQ ID NO: 39379 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aattaaagatgacctggtta

SEQ ID NO: 39380 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atggtttccctttattctct

SEQ ID NO: 39381 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tccctttattctcttggatt

SEQ ID NO: 39382 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcttggatttggtaatatt

SEQ ID NO: 39383 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttaattgtttgctattgaa

SEQ ID NO: 39384 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttaattgtttgctattgaat

SEQ ID NO: 39385 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attgtttgctattgaatggg

SEQ ID NO: 39386 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cttattcatcaaacacctaa

SEQ ID NO: 39387 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atcaaacacctaatggtaac

SEQ ID NO: 39388 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccagacttccctttctgcct

SEQ ID NO: 39389 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agacttccctttctgcctta

SEQ ID NO: 39390 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gttgttgttgttgtttttga

SEQ ID NO: 39391 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgttgttgttgtttttgatg

SEQ ID NO: 39392 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttttgatggagtcttgctct

SEQ ID NO: 39393 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttgatggagtcttgctctg

SEQ ID NO: 39394 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tggagtcttgctctgaggca

SEQ ID NO: 39395 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggagtcttgctctgaggcac

SEQ ID NO: 39396 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcttgctctgaggcacaggc

SEQ ID NO: 39397 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgctctgaggcacaggctg

SEQ ID NO: 39398 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgaggcacaggctggagtg

SEQ ID NO: 39399 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggagtgcagtgccaccatct

SEQ ID NO: 39400 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcactgcaacctccacctcc

SEQ ID NO: 39401 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cactgcaacctccacctcct

SEQ ID NO: 39402 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacctccacctcctgggttc

SEQ ID NO: 39403 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcaagtaattctcatgtct

SEQ ID NO: 39404 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttctcatgtctcagcctccc

SEQ ID NO: 39405 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcatgtctcagcctcccaag

SEQ ID NO: 39406 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtctcagcctcccaagtagc

SEQ ID NO: 39407 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tctcagcctcccaagtagct

SEQ ID NO: 39408 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcccaagtagctgggatta

SEQ ID NO: 39409 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcccaagtagctgggattac

SEQ ID NO: 39410 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acaggtgcatgccaccacat

SEQ ID NO: 39411 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caggtgcatgccaccacatc

SEQ ID NO: 39412 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caggctaatttttgtatttt

SEQ ID NO: 39413 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gctaatttttgtatttttag

SEQ ID NO: 39414 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taatttttgtatttttagta

SEQ ID NO: 39415 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttttgtatttttagtagaga

SEQ ID NO: 39416 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttgtatttttagtagagac

SEQ ID NO: 39417 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttgtatttttagtagagaca

SEQ ID NO: 39418 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gagacagggtttcaccatgt

SEQ ID NO: 39419 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cagggtttcaccatgttggc

SEQ ID NO: 39420 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttcaccatgttggctggtc

SEQ ID NO: 39421 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctggtctggttttgaactcc

SEQ ID NO: 39422 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggttttgaactcctggcctc

SEQ ID NO: 39423 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cctggcctcaagtgatctgc

SEQ ID NO: 39424 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctcaagtgatctgccagcct

SEQ ID NO: 39425 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgccagccttggcctccca

SEQ ID NO: 39426 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gccttggcctcccaaagtgc

SEQ ID NO: 39427 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccttggcctcccaaagtgct

SEQ ID NO: 39428 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcccaaagtgctgggatta

SEQ ID NO: 39429 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcccaaagtgctgggattac

SEQ ID NO: 39430 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtgctgggattacaggcgt

SEQ ID NO: 39431 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
caggcgtgagccaccatatc

SEQ ID NO: 39432 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gccaccatatccggccacct

SEQ ID NO: 39433 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caccatatccggccacctta

SEQ ID NO: 39434 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caccttagagtgttttaatt

SEQ ID NO: 39435 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gctttcctctatttaatatg

SEQ ID NO: 39436 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcatattcatctcacctac

SEQ ID NO: 39437 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tattcatctcacctactggc

SEQ ID NO: 39438 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attcatctcacctactggca

SEQ ID NO: 39439 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctcacctactggcaaggcat

SEQ ID NO: 39440 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cacctactggcaaggcatga

SEQ ID NO: 39441 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cctactggcaaggcatgaga

SEQ ID NO: 39442 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctggcaaggcatgagagaga

SEQ ID NO: 39443 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acagacttcatgtcaatgtc

SEQ ID NO: 39444 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agacttcatgtcaatgtcaa

SEQ ID NO: 39445 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtcaatgtcaagagaaacc

SEQ ID NO: 39446 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gatcctttactgttcattaa

SEQ ID NO: 39447 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atcctttactgttcattaat

SEQ ID NO: 39448 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcctttactgttcattaatg

SEQ ID NO: 39449 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttaatggggactgaaaatta

SEQ ID NO: 39450 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actgaaaattacagcatgcc

SEQ ID NO: 39451 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acagcatgccaagaacttga

SEQ ID NO: 39452 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcatgccaagaacttgacag

SEQ ID NO: 39453 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgccaagaacttgacagaag

SEQ ID NO: 39454 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagaacttgacagaagaagc

SEQ ID NO: 39455 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaacttgacagaagaagctg

SEQ ID NO: 39456 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaagaagctggagaaaaact

SEQ ID NO: 39457 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagaagctggagaaaaactg

SEQ ID NO: 39458 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaagctggagaaaaactgag

SEQ ID NO: 39459 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggagaaaactccaactttg

SEQ ID NO: 39460 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gagaaaactccaactttgaa

SEQ ID NO: 39461 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caactttgaagagaaaatca

SEQ ID NO: 39462 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgaagagaaaatcaaagtaa

SEQ ID NO: 39463 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gttttcccctaatgatatcc

SEQ ID NO: 39464 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcctggttgtcaatatgatg

SEQ ID NO: 39465 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gttgtcaatatgatgaagaa

SEQ ID NO: 39466 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttgtcaatatgatgaagaat

SEQ ID NO: 39467 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaagaatgggataaaactaa

SEQ ID NO: 39468 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagaatgggataaaactaat

SEQ ID NO: 39469 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaatgggataaaactaatag

SEQ ID NO: 39470 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagattatgaattaattcaa

SEQ ID NO: 39471 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gattatgaattaattcaata

SEQ ID NO: 39472 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attcaatagagaaacttgcg

SEQ ID NO: 39473 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttcaatagagaaacttgcgt

SEQ ID NO: 39474 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtgggtgttttgttttccta

SEQ ID NO: 39475 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgttttcctatagcttatt

SEQ ID NO: 39476 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgttttcctatagcttattt

SEQ ID NO: 39477 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatgtatccctttaaaacc

SEQ ID NO: 39478 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatgtatccctttaaaacct

SEQ ID NO: 39479 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtatccctttaaaacctagg

SEQ ID NO: 39480 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tccctttaaaacctaggtgg

SEQ ID NO: 39481 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccctttaaaacctaggtgga

SEQ ID NO: 39482 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctaggtggaaggaattctgt

SEQ ID NO: 39483 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtggaaggaattctgtaagt

SEQ ID NO: 39484 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggaaggaattctgtaagtc

SEQ ID NO: 39485 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aggaattctgtaagtcaggc

SEQ ID NO: 39486 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctgtgttacaatctacatt

SEQ ID NO: 39487 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctgtgttacaatctacattg

SEQ ID NO: 39488 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacattgaggctgtattaca

SEQ ID NO: 39489 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggctgtattacatagtaata

SEQ ID NO: 39490 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aataaagacttcttcacttc

SEQ ID NO: 39491 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gacttcttcacttctggtgt

SEQ ID NO: 39492 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgtcagatcatctttgttc

SEQ ID NO: 39493 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caagtcctttcttttgtcct

SEQ ID NO: 39494 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aagtcctttcttttgtcctt

SEQ ID NO: 39495 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cctttcttttgtccttgggt

SEQ ID NO: 39496 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggtaagtttcttaattcttt

SEQ ID NO: 39497 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaaccacctcatcattat

SEQ ID NO: 39498 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaccacctcatcattataa

SEQ ID NO: 39499 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccacctcatcattataagag

SEQ ID NO: 39500 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcactgcatttgtgtttgct

SEQ ID NO: 39501 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgcatttgtgtttgctgag

SEQ ID NO: 39502 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtttgctgagaagataaatt

SEQ ID NO: 39503 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttgctgagaagataaattg

SEQ ID NO: 39504 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataaattgaggtaatgcatg

SEQ ID NO: 39505 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggtaatgcatgaagaatact

SEQ ID NO: 39506 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agaatacttagcataatatc

SEQ ID NO: 39507 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttagcataatatctggcaca

SEQ ID NO: 39508 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cataatatctggcacatggt

SEQ ID NO: 39509 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggtaagtcttcattaaattt

SEQ ID NO: 39510 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attttagttactattactgt

SEQ ID NO: 39511 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgctattaaacttcctgat

SEQ ID NO: 39512 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attaaacttcctgataagat

SEQ ID NO: 39513 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taaacttcctgataagatga

SEQ ID NO: 39514 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagatgagagttaatgaaat

SEQ ID NO: 39515 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agatgagagttaatgaaatg

SEQ ID NO: 39516 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tattgttaacatttactcca

SEQ ID NO: 39517 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attaatgacttttgttctaa

SEQ ID NO: 39518 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatgacttttgttctaatag

SEQ ID NO: 39519 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctaatttcacatgaaatcat

SEQ ID NO: 39520 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatttcacatgaaatcatta

SEQ ID NO: 39521 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atttcacatgaaatcattag

SEQ ID NO: 39522 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaatcattagaggtgaaaa

SEQ ID NO: 39523 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaggtgaaaaaagtacttat

SEQ ID NO: 39524 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aggtgaaaaaagtacttatg

SEQ ID NO: 39525 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtacttatgaggatgatgaa

SEQ ID NO: 39526 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttatgaggatgatgaatagt

SEQ ID NO: 39527 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgatgaatagttggaaaaac

SEQ ID NO: 39528 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agttggaaaaactagtaaaa

SEQ ID NO: 39529 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gttggaaaaactagtaaaat

SEQ ID NO: 39530 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttggaaaaactagtaaaata

SEQ ID NO: 39531 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaaactagtaaaatagggt

SEQ ID NO: 39532 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtaaaatagggttggttat

SEQ ID NO: 39533 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatagggttggttattaga

SEQ ID NO: 39534 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atagggttggttattagaaa

SEQ ID NO: 39535 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tagggttggttattagaaag

SEQ ID NO: 39536 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttggttattagaaagaggca

SEQ ID NO: 39537 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tggttattagaaagaggcat

SEQ ID NO: 39538 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttattagaaagaggcatggg

SEQ ID NO: 39539 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaagaggcatgggtagttga

SEQ ID NO: 39540 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaggcatgggtagttgata

SEQ ID NO: 39541 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgggtagttgatagagccat

SEQ ID NO: 39542 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagctttgatcaaattattg

SEQ ID NO: 39543 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atcaaattattgaagttaaa

SEQ ID NO: 39544 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaattattgaagttaaaaag

SEQ ID NO: 39545 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tattgaagttaaaaagcagt

SEQ ID NO: 39546 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgaagttaaaaagcagtaag

SEQ ID NO: 39547 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taagtggcaacattgcattg

SEQ ID NO: 39548 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggcaacattgcattgtggaa

SEQ ID NO: 39549 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attgcattgtggaaaagata

SEQ ID NO: 39550 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttgcattgtggaaaagatat

SEQ ID NO: 39551 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atatgggttttcaaatcaaa

SEQ ID NO: 39552 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatgggttttcaaatcaaac

SEQ ID NO: 39553 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catttcaatcataactgtgc

SEQ ID NO: 39554 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtgctggtatcctgttact

SEQ ID NO: 39555 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aacaatttatccatcctttc

SEQ ID NO: 39556 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acaatttatccatcctttct

SEQ ID NO: 39557 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caatttatccatcctttcta

SEQ ID NO: 39558 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aatttatccatcctttctag

SEQ ID NO: 39559 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctaatttattcattttcatc

SEQ ID NO: 39560 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcatcaagataccactttc

SEQ ID NO: 39561 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcatcaagataccactttca

SEQ ID NO: 39562 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
catcaagataccactttcaa

SEQ ID NO: 39563 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcaagataccactttcaagg

SEQ ID NO: 39564 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caagataccactttcaaggg

SEQ ID NO: 39565 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aagataccactttcaaggga

SEQ ID NO: 39566 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gataccactttcaagggagg

SEQ ID NO: 39567 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taccactttcaagggaggga

SEQ ID NO: 39568 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
accactttcaagggagggag

SEQ ID NO: 39569 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cactttcaagggagggagag

SEQ ID NO: 39570 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttcaagggagggagaggag

SEQ ID NO: 39571 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcaagggagggagaggagtg

SEQ ID NO: 39572 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catcaaatgtccttgccatt

SEQ ID NO: 39573 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgccattcagtgtgctgcac

SEQ ID NO: 39574 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gccattcagtgtgctgcact

SEQ ID NO: 39575 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccattcagtgtgctgcacta

SEQ ID NO: 39576 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagtgtgctgcactagggtc

SEQ ID NO: 39577 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtttcactcttgcctcata

SEQ ID NO: 39578 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttcactcttgcctcatatg

SEQ ID NO: 39579 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcctcatatggagcactga

SEQ ID NO: 39580 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atatggagcactgaaagaac

SEQ ID NO: 39581 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
actgaaagaaccagtatgat

SEQ ID NO: 39582 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatgattagaacaattgata

SEQ ID NO: 39583 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aattgatacagctacaaaca

SEQ ID NO: 39584 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attgatacagctacaaacat

SEQ ID NO: 39585 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacagctacaaacataggaa

SEQ ID NO: 39586 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acagctacaaacataggaaa

SEQ ID NO: 39587 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cagctacaaacataggaaaa

SEQ ID NO: 39588 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agctacaaacataggaaaag

SEQ ID NO: 39589 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
acaaacataggaaaagggga

SEQ ID NO: 39590 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aacataggaaaaggggacgg

SEQ ID NO: 39591 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aggaaaaggggacggtagat

SEQ ID NO: 39592 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggacggtagattagctgttt

SEQ ID NO: 39593 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acggtagattagctgtttga

SEQ ID NO: 39594 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttagctgtttgagagactct

SEQ ID NO: 39595 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgagagactctcagtatctc

SEQ ID NO: 39596 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agactctcagtatctctagc

SEQ ID NO: 39597 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gactctcagtatctctagcc

SEQ ID NO: 39598 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtatctctagccaggctgac

SEQ ID NO: 39599 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctagccaggctgactggca

SEQ ID NO: 39600 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctagccaggctgactggcaa

SEQ ID NO: 39601 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcaaaggtcttgccctgtca

SEQ ID NO: 39602 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aggtcttgccctgtcaaagt

SEQ ID NO: 39603 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caaagtcagtccataaatct

SEQ ID NO: 39604 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtcagtccataaatcttgg

SEQ ID NO: 39605 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tgtcctttgtgacattgtgt

SEQ ID NO: 39606 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctttgtgacattgtgtcgga

SEQ ID NO: 39607 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acattgtgtcggatggctga

SEQ ID NO: 39608 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cattgtgtcggatggctgac

SEQ ID NO: 39609 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtgtcggatggctgacagg

SEQ ID NO: 39610 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtggctattcttccaatgca

SEQ ID NO: 39611 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgcacagacaccaatgca

SEQ ID NO: 39612 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagacaccaatgcaaagcac

SEQ ID NO: 39613 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agacaccaatgcaaagcaca

SEQ ID NO: 39614 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcaaagcacaaggaacaca

SEQ ID NO: 39615 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcacaaggaacacaaagaat

SEQ ID NO: 39616 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cacaaggaacacaaagaatt

SEQ ID NO: 39617 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acaaggaacacaaagaatta

SEQ ID NO: 39618 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaattagggaaacaacaaa

SEQ ID NO: 39619 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaattagggaaacaacaaaa

SEQ ID NO: 39620 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aattagggaaacaacaaaaa

SEQ ID NO: 39621 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaacaacaaaaagggataa

SEQ ID NO: 39622 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaagggataaaagaaatccg

SEQ ID NO: 39623 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atccgcagttactgacccta

SEQ ID NO: 39624 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agttactgaccctaaagaaa

SEQ ID NO: 39625 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttactgaccctaaagaaata

SEQ ID NO: 39626 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatttataaattgcctaaaa

SEQ ID NO: 39627 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcaaaataattatcctaatg

SEQ ID NO: 39628 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ataattatcctaatgaagtt

SEQ ID NO: 39629 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatcctaatgaagtttagca

SEQ ID NO: 39630 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatgaagtttagcaaagtac

SEQ ID NO: 39631 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgaagtttagcaaagtacca

SEQ ID NO: 39632 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttagcaaagtaccagagaa

SEQ ID NO: 39633 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tagcaaagtaccagagaaca

SEQ ID NO: 39634 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaagtaccagagaacagaga

SEQ ID NO: 39635 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gatagacaactaaacaaaat

SEQ ID NO: 39636 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atagacaactaaacaaaatc

SEQ ID NO: 39637 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gacaactaaacaaaatcagg

SEQ ID NO: 39638 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agatgatacatgaacacaat

SEQ ID NO: 39639 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gatgatacatgaacacaatg

SEQ ID NO: 39640 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acacaatgaggatatcaatg

SEQ ID NO: 39641 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cacaatgaggatatcaatga

SEQ ID NO: 39642 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acaatgaggatatcaatgaa

SEQ ID NO: 39643 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaggatatcaatgaaggga

SEQ ID NO: 39644 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actatacacacacacacaaa

SEQ ID NO: 39645 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acacacaaaaagtcaaatat

SEQ ID NO: 39646 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcaaatatcagtaaaaactc

SEQ ID NO: 39647 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagtaaaaactctggaattg

SEQ ID NO: 39648 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aattgaactaaaaaactccc

SEQ ID NO: 39649 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgaactaaaaaactcccta

SEQ ID NO: 39650 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgaactaaaaaactccctag

SEQ ID NO: 39651 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaactccctagaggattcaa

SEQ ID NO: 39652 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctccctagaggattcaatag

SEQ ID NO: 39653 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatagcagacttgatcaaac

SEQ ID NO: 39654 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tagcagacttgatcaaactg

SEQ ID NO: 39655 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agacttgatcaaactggaga

SEQ ID NO: 39656 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggagaaagaatcaacaaacc

SEQ ID NO: 39657 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaacaaccccatcaaaaac

SEQ ID NO: 39658 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaacaaccccatcaaaaact

SEQ ID NO: 39659 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
accccatcaaaaactgggta

SEQ ID NO: 39660 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccccatcaaaaactgggtaa

SEQ ID NO: 39661 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aactgggtaaaggatatgaa

SEQ ID NO: 39662 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatgaacagacacttctcaa

SEQ ID NO: 39663 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaacagacacttctcaaaag

SEQ ID NO: 39664 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcaaaagaagacatttatg

SEQ ID NO: 39665 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaaaaaatgctcatcatcac

SEQ ID NO: 39666 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgctcatcatcactggccat

SEQ ID NO: 39667 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctcatcatcactggccatca

SEQ ID NO: 39668 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgcaaatcaaaaccgcaat

SEQ ID NO: 39669 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatgagataccatctcatac

SEQ ID NO: 39670 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agataccatctcataccagt

SEQ ID NO: 39671 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccatctcataccagttagaa

SEQ ID NO: 39672 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttagaatggtgatcattaaa

SEQ ID NO: 39673 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatggtgatcattaaaaagt

SEQ ID NO: 39674 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atggtgatcattaaaaagtc

SEQ ID NO: 39675 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attaaaaagtcaggaaacaa

SEQ ID NO: 39676 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttaaaaagtcaggaaacaac

SEQ ID NO: 39677 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtcaggaaacaacaggtgc

SEQ ID NO: 39678 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcaggaaacaacaggtgctg

SEQ ID NO: 39679 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aggaaacaacaggtgctgga

SEQ ID NO: 39680 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggaaacaacaggtgctggag

SEQ ID NO: 39681 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aacaggtgctggagaggatg

SEQ ID NO: 39682 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caggtgctggagaggatgtg

SEQ ID NO: 39683 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctggagaggatgtggagaaa

SEQ ID NO: 39684 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggagaggatgtggagaaat

SEQ ID NO: 39685 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taggaacacttttacactgt

SEQ ID NO: 39686 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaacacttttacactgttgg

SEQ ID NO: 39687 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aacacttttacactgttggt

SEQ ID NO: 39688 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgttggtgggactgtaaac

SEQ ID NO: 39689 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtaaactagttcaaccactg

SEQ ID NO: 39690 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aactagttcaaccactgtgg

SEQ ID NO: 39691 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaccactgtggaagtccgtg

SEQ ID NO: 39692 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agtccgtgtggcgattcctc

SEQ ID NO: 39693 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtccgtgtggcgattcctca

SEQ ID NO: 39694 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtggcgattcctcaaggatc

SEQ ID NO: 39695 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attcctcaaggatctagaac

SEQ ID NO: 39696 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actagaaataccatttgacc

SEQ ID NO: 39697 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgacccagccatcccatgac

SEQ ID NO: 39698 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gacccagccatcccatgact

SEQ ID NO: 39699 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catgactgggtatataccca

SEQ ID NO: 39700 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgactgggtatatacccaa

SEQ ID NO: 39701 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttataaatcatgctgctata

SEQ ID NO: 39702 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
atgcacacgtatgtttattg

SEQ ID NO: 39703 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tattgcggcactattcacaa

SEQ ID NO: 39704 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cggcactattcacaatagca

SEQ ID NO: 39705 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tattcacaatagcaaagact

SEQ ID NO: 39706 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatagcaaagacttggaacc

SEQ ID NO: 39707 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agccaaatgtccaacaatga

SEQ ID NO: 39708 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatgtccaacaatgatagac

SEQ ID NO: 39709 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caacaatgatagactggatt

SEQ ID NO: 39710 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagactggattaagaaaata

SEQ ID NO: 39711 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatatggcacatatacacca

SEQ ID NO: 39712 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atacaccatggaatactatg

SEQ ID NO: 39713 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatactatgcagccataaaa

SEQ ID NO: 39714 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atactatgcagccataaaaa

SEQ ID NO: 39715 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgcagccataaaaaaggat

SEQ ID NO: 39716 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccataaaaaaggatgagctc

SEQ ID NO: 39717 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggatgagctcaagtcctttg

SEQ ID NO: 39718 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gatgagctcaagtcctttgc

SEQ ID NO: 39719 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgagctcaagtcctttgca

SEQ ID NO: 39720 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cctttgcagggacatgcatg

SEQ ID NO: 39721 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgcagggacatgcatgaagc

SEQ ID NO: 39722 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagctggaaaccatcattct

SEQ ID NO: 39723 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cattctcagcaaactatcgc

SEQ ID NO: 39724 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attctcagcaaactatcgca

SEQ ID NO: 39725 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acactgcactttctcactca

SEQ ID NO: 39726 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cactgcactttctcactcat

SEQ ID NO: 39727 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgcactttctcactcatagg

SEQ ID NO: 39728 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcactttctcactcataggt

SEQ ID NO: 39729 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ataggtgggaattgaacaat

SEQ ID NO: 39730 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aattgaacaatgagaacaca

SEQ ID NO: 39731 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acaatgagaacacatggaca

SEQ ID NO: 39732 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caatgagaacacatggacac

SEQ ID NO: 39733 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgagaacacatggacacagg

SEQ ID NO: 39734 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagaacacatggacacagga

SEQ ID NO: 39735 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agaacacatggacacaggaa

SEQ ID NO: 39736 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaacacatggacacaggaag

SEQ ID NO: 39737 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggaaggggaccatcacacac

SEQ ID NO: 39738 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaggggaccatcacacacc

SEQ ID NO: 39739 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaggggaccatcacacacca

SEQ ID NO: 39740 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcacacaccagggcctgttg

SEQ ID NO: 39741 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cacacaccagggcctgttgt

SEQ ID NO: 39742 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acacaccagggcctgttgtg

SEQ ID NO: 39743 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caccagggcctgttgtgggg

SEQ ID NO: 39744 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
accagggcctgttgtggggt

SEQ ID NO: 39745 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccagggcctgttgtggggtg

SEQ ID NO: 39746 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cagggcctgttgtggggtgg

SEQ ID NO: 39747 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agggcctgttgtggggtggg

SEQ ID NO: 39748 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggcctgttgtggggtggggg

SEQ ID NO: 39749 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcctgttgtggggtgggggg

SEQ ID NO: 39750 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgttgtggggtggggggag

SEQ ID NO: 39751 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgttgtggggtggggggagg

SEQ ID NO: 39752 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gttgtggggtggggggagga

SEQ ID NO: 39753 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttgtggggtggggggaggag

SEQ ID NO: 39754 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgtggggtggggggaggagg

SEQ ID NO: 39755 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagggggatatacctaacat

SEQ ID NO: 39756 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agggggatatacctaacatt

SEQ ID NO: 39757 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggggatatacctaacattag

SEQ ID NO: 39758 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatacctaatgttaaatgat

SEQ ID NO: 39759 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatgttaaatgatgagttaa

SEQ ID NO: 39760 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgttaaatgatgagttaat

SEQ ID NO: 39761 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatgatgagttaatgggtg

SEQ ID NO: 39762 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgggtgtagcacaccaaca

SEQ ID NO: 39763 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cacatgtaccctaaaactta

SEQ ID NO: 39764 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaattaaaaaaccctcaa

SEQ ID NO: 39765 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attaaaaaaccctcaaaaga

SEQ ID NO: 39766 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggacaccaaaaaaaaaaaaa

SEQ ID NO: 39767 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gacaccaaaaaaaaaaaaaa

SEQ ID NO: 39768 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
accaaaaaaaaaaaaaaagg

SEQ ID NO: 39769 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtagatcatttaaaattatc

SEQ ID NO: 39770 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atcatttaaaattatccagt

SEQ ID NO: 39771 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atttaaaattatccagtcag

SEQ ID NO: 39772 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttaaaattatccagtcagtg

SEQ ID NO: 39773 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattatccagtcagtggagc

SEQ ID NO: 39774 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatccagtcagtggagcaag

SEQ ID NO: 39775 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaagaaataaaaaaaaaaat

SEQ ID NO: 39776 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aataaaaaaaaaaatgagtg

SEQ ID NO: 39777 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ataaaaaaaaaaatgagtga

SEQ ID NO: 39778 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaaaatgagtgaaggttca

SEQ ID NO: 39779 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaaatgagtgaaggttcat

SEQ ID NO: 39780 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaggttcatgggacatcatt

SEQ ID NO: 39781 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gttcatgggacatcattaag

SEQ ID NO: 39782 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atatatgcattatgaaatca

SEQ ID NO: 39783 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atatgcattatgaaatcaca

SEQ ID NO: 39784 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcattatgaaatcacagag

SEQ ID NO: 39785 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttatgaaatcacagagaaga

SEQ ID NO: 39786 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaatcacagagaagacaga

SEQ ID NO: 39787 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaatcacagagaagacagaa

SEQ ID NO: 39788 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aatcacagagaagacagaaa

SEQ ID NO: 39789 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atcacagagaagacagaaag

SEQ ID NO: 39790 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gactaaaatatgttcaaatt

SEQ ID NO: 39791 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
actaaaatatgttcaaattt

SEQ ID NO: 39792 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctaaaatatgttcaaatttg

SEQ ID NO: 39793 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaatatgttcaaatttggg

SEQ ID NO: 39794 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatatgttcaaatttgggga

SEQ ID NO: 39795 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagatatgaacatctaaatt

SEQ ID NO: 39796 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agatatgaacatctaaattc

SEQ ID NO: 39797 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atctaaattcaggaaactca

SEQ ID NO: 39798 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaaactcaaagaatcccaaa

SEQ ID NO: 39799 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaactcaaagaatcccaaat

SEQ ID NO: 39800 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcccaaataggacaaatcta

SEQ ID NO: 39801 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaataggacaaatctaaag

SEQ ID NO: 39802 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ggacaaatctaaagaagtct

SEQ ID NO: 39803 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaatctaaagaagtctcggc

SEQ ID NO: 39804 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aatctaaagaagtctcggct

SEQ ID NO: 39805 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaagaagtctcggctgggca

SEQ ID NO: 39806 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaagtctcggctgggcatgg

SEQ ID NO: 39807 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtggctcacacctgtaatcc

SEQ ID NO: 39808 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acctgtaatcccagcacttt

SEQ ID NO: 39809 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cctgtaatcccagcactttg

SEQ ID NO: 39810 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctgtaatcccagcactttga

SEQ ID NO: 39811 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgtaatcccagcactttgag

SEQ ID NO: 39812 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcccagcactttgaggggct

SEQ ID NO: 39813 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
cagcactttgaggggctgag

SEQ ID NO: 39814 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agcactttgaggggctgagc

SEQ ID NO: 39815 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cactttgaggggctgagcgg

SEQ ID NO: 39816 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttgaggggctgagcgggag

SEQ ID NO: 39817 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgagcgggagtggatcacct

SEQ ID NO: 39818 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagcgggagtggatcacctg

SEQ ID NO: 39819 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gggagtggatcacctgaggt

SEQ ID NO: 39820 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggagtggatcacctgaggtc

SEQ ID NO: 39821 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtggatcacctgaggtcag

SEQ ID NO: 39822 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcacctgaggtcaggagttc

SEQ ID NO: 39823 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgaggtcaggagttcaagac

SEQ ID NO: 39824 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcaggagttcaagaccagcc

SEQ ID NO: 39825 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caagaccagcctggccaaca

SEQ ID NO: 39826 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctaccaaaaattacaaaaat

SEQ ID NO: 39827 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caaaaattacaaaaatcagc

SEQ ID NO: 39828 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaaattacaaaaatcagct

SEQ ID NO: 39829 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttacaaaaatcagctgggtg

SEQ ID NO: 39830 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caaaaatcagctgggtgtgg

SEQ ID NO: 39831 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaatcagctgggtgtggtgg

SEQ ID NO: 39832 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aatcagctgggtgtggtggt

SEQ ID NO: 39833 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtggtgggtgcctataatcc

SEQ ID NO: 39834 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tgcctataatcccagctact

SEQ ID NO: 39835 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcctataatcccagctactc

SEQ ID NO: 39836 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctataatcccagctactcgg

SEQ ID NO: 39837 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tataatcccagctactcggg

SEQ ID NO: 39838 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcccagctactcgggaggct

SEQ ID NO: 39839 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccagctactcgggaggctg

SEQ ID NO: 39840 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agctactcgggaggctgagg

SEQ ID NO: 39841 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctactcgggaggctgaggca

SEQ ID NO: 39842 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
actcgggaggctgaggcaga

SEQ ID NO: 39843 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agagaattgcttgaacccac

SEQ ID NO: 39844 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagaattgcttgaacccacg

SEQ ID NO: 39845 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aattgcttgaacccacgagg

SEQ ID NO: 39846 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcttgaacccacgaggtgg

SEQ ID NO: 39847 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacccacgaggtggaagttg

SEQ ID NO: 39848 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cacgaggtggaagttgcagt

SEQ ID NO: 39849 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggtggaagttgcagtgagcc

SEQ ID NO: 39850 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagatcatgctactgcactc

SEQ ID NO: 39851 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catgctactgcactccagcc

SEQ ID NO: 39852 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgctactgcactccagcct

SEQ ID NO: 39853 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gcactccagcctgggcaaca

SEQ ID NO: 39854 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aacacggtgaaactctatct

SEQ ID NO: 39855 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaactctatctcggaaaaaa

SEQ ID NO: 39856 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctatctcggaaaaaaaaga

SEQ ID NO: 39857 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctcggaaaaaaaagaaaga

SEQ ID NO: 39858 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaagaaagaaagtctccac

SEQ ID NO: 39859 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagaaagaaagtctccacta

SEQ ID NO: 39860 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taatatcatcaaattgccaa

SEQ ID NO: 39861 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catcaaattgccaaaagtga

SEQ ID NO: 39862 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atcaaattgccaaaagtgaa

SEQ ID NO: 39863 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcaaattgccaaaagtgaaa

SEQ ID NO: 39864 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattgccaaaagtgaaaggg

SEQ ID NO: 39865 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagtgaaagggaagtttga

SEQ ID NO: 39866 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtgaaagggaagtttgaaag

SEQ ID NO: 39867 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagggaagtttgaaagcagc

SEQ ID NO: 39868 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aactgaattgtcatgtccaa

SEQ ID NO: 39869 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgaattgtcatgtccaaaa

SEQ ID NO: 39870 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgtccaaaagagctctctt

SEQ ID NO: 39871 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagagctctcttaagatgaa

SEQ ID NO: 39872 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agctctcttaagatgaacag

SEQ ID NO: 39873 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagatgaacagcagatttct

SEQ ID NO: 39874 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgaacagcagatttctcag

SEQ ID NO: 39875 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttctcagtggaaactttaa

SEQ ID NO: 39876 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctcagtggaaactttaaaa

SEQ ID NO: 39877 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaactttaaaagagcaaata

SEQ ID NO: 39878 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaagagcaaataaagtga

SEQ ID NO: 39879 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtatatattcaaaatactta

SEQ ID NO: 39880 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagaaaaaaactgctgacc

SEQ ID NO: 39881 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctgaccaagaataatatacc

SEQ ID NO: 39882 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaactgtcctttaaaatt

SEQ ID NO: 39883 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaactgtcctttaaaatta

SEQ ID NO: 39884 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actgtcctttaaaattaagg

SEQ ID NO: 39885 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctgtcctttaaaattaagga

SEQ ID NO: 39886 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggataaaaactttctcatac

SEQ ID NO: 39887 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttctcatacaagcaaatgct

SEQ ID NO: 39888 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctcatacaagcaaatgctg

SEQ ID NO: 39889 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctcatacaagcaaatgctga

SEQ ID NO: 39890 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
catacaagcaaatgctgagg

SEQ ID NO: 39891 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgagggagttcatcaccac

SEQ ID NO: 39892 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcaccactagatttatctta

SEQ ID NO: 39893 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caccactagatttatcttat

SEQ ID NO: 39894 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatcttataggaaatgcta

SEQ ID NO: 39895 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cttataggaaatgctaaagt

SEQ ID NO: 39896 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgctaaagtgagttcttc

SEQ ID NO: 39897 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agttcttcaagttgaaacga

SEQ ID NO: 39898 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcaagttgaaacgaaagca

SEQ ID NO: 39899 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttgaaacgaaagcatggta

SEQ ID NO: 39900 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgaaacgaaagcatggtaaa

SEQ ID NO: 39901 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcatggtaaagagcaacac

SEQ ID NO: 39902 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
catggtaaagagcaacacaa

SEQ ID NO: 39903 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcaacacaagagcatatga

SEQ ID NO: 39904 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatgaaagcacaaatctcac

SEQ ID NO: 39905 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagcacaaatctcactagta

SEQ ID NO: 39906 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agcacaaatctcactagtaa

SEQ ID NO: 39907 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cactagtaaaggtaaataca

SEQ ID NO: 39908 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaggtaaatacatggacaaa

SEQ ID NO: 39909 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggtaaatacatggacaaata

SEQ ID NO: 39910 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agaatactgtaatactctaa

SEQ ID NO: 39911 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catttataattctaatataa

SEQ ID NO: 39912 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agttaaatgtcaaaataatt

SEQ ID NO: 39913 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaattacaaaaatgtgtttg

SEQ ID NO: 39914 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgtagaaacacattataaa

SEQ ID NO: 39915 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtaaattgtgacataacaaa

SEQ ID NO: 39916 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtgacataacaaaaagtgt

SEQ ID NO: 39917 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtgacataacaaaaagtgtg

SEQ ID NO: 39918 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgacataacaaaaagtgtga

SEQ ID NO: 39919 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acataacaaaaagtgtgagg

SEQ ID NO: 39920 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cataacaaaaagtgtgaggg

SEQ ID NO: 39921 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagtgtgagggaggtattaa

SEQ ID NO: 39922 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgagggaggtattaaaagtg

SEQ ID NO: 39923 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agatttttgatatatgattg

SEQ ID NO: 39924 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttgatatatgattgaagtt

SEQ ID NO: 39925 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gattgaagttaagttgttat

SEQ ID NO: 39926 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttaagttgttatcagctta

SEQ ID NO: 39927 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagttgttatcagcttaaag

SEQ ID NO: 39928 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcttaaagtagactattat

SEQ ID NO: 39929 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gattgcctcatgataaccac

SEQ ID NO: 39930 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attgcctcatgataaccaca

SEQ ID NO: 39931 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggaaaatccacgtaaaaata

SEQ ID NO: 39932 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtaaaaatacagaaataaaa

SEQ ID NO: 39933 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaaatacagaaataaaaaa

SEQ ID NO: 39934 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaaataaaaaagagaaatca

SEQ ID NO: 39935 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaatatcatccaatcacaa

SEQ ID NO: 39936 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatcatccaatcacaaaag

SEQ ID NO: 39937 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catccaatcacaaaagaaga

SEQ ID NO: 39938 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatcacaaaagaagacagtt

SEQ ID NO: 39939 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcacaaaagaagacagttaa

SEQ ID NO: 39940 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acaaaagaagacagttaaga

SEQ ID NO: 39941 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaagacagttaagagagaaa

SEQ ID NO: 39942 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acagttaagagagaaaaaga

SEQ ID NO: 39943 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagagaaaaagacagaaaaa

SEQ ID NO: 39944 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaaaaaaagaattacaaaa

SEQ ID NO: 39945 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaacagaaaaatttaacaaa

SEQ ID NO: 39946 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aacagaaaaatttaacaaaa

SEQ ID NO: 39947 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaatttaacaaaaaggcaa

SEQ ID NO: 39948 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttaacaaaaaggcaatagt

SEQ ID NO: 39949 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgattatttcaaatacaaa

SEQ ID NO: 39950 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggattaaacttcccaatcaa

SEQ ID NO: 39951 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cccaatcaaaagacctacaa

SEQ ID NO: 39952 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaagacctacaatggctgca

SEQ ID NO: 39953 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgcatagatttatgaaaac

SEQ ID NO: 39954 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agatttatgaaaacaagatc

SEQ ID NO: 39955 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atccagttatatgctgtctc

SEQ ID NO: 39956 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgtctccagatactcgttt

SEQ ID NO: 39957 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagatactcgtttcagattt

SEQ ID NO: 39958 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtttcagatttaagaaaaca

SEQ ID NO: 39959 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttaagaaaacatagtttga

SEQ ID NO: 39960 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgaaagttaattgataaaa

SEQ ID NO: 39961 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gataaaaaagatacattttg

SEQ ID NO: 39962 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaagatacattttgtagaaa

SEQ ID NO: 39963 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttgtagaaatggtaaccaa

SEQ ID NO: 39964 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtagaaatggtaaccaaaa

SEQ ID NO: 39965 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tagaaatggtaaccaaaaga

SEQ ID NO: 39966 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggtaaccaaaagagagcaa

SEQ ID NO: 39967 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggtaaccaaaagagagcaat

SEQ ID NO: 39968 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtaaccaaaagagagcaatg

SEQ ID NO: 39969 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagagagcaatggggctata

SEQ ID NO: 39970 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggggctatacagtcgtcctt

SEQ ID NO: 39971 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagtcgtccttcagtatcta

SEQ ID NO: 39972 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtcgtccttcagtatctac

SEQ ID NO: 39973 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtcgtccttcagtatctaca

SEQ ID NO: 39974 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cttcagtatctacagggtca

SEQ ID NO: 39975 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatctacagggtcatggttt

SEQ ID NO: 39976 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggtcatggtttcagaacccc

SEQ ID NO: 39977 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtcatggtttcagaacccca

SEQ ID NO: 39978 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcatggtttcagaaccccaa

SEQ ID NO: 39979 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccccaagggataccaaaatt

SEQ ID NO: 39980 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccaagggataccaaaattg

SEQ ID NO: 39981 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taccaaaattgaggatgctt

SEQ ID NO: 39982 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgaggatgcttaagtccca

SEQ ID NO: 39983 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggatgcttaagtcccacagt

SEQ ID NO: 39984 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagtcccacagtcagtcttg

SEQ ID NO: 39985 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtcccacagtcagtcttgc

SEQ ID NO: 39986 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtcagtcttgcaggacctg

SEQ ID NO: 39987 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatttgaccctctgtatctg

SEQ ID NO: 39988 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gatttcacattccatgaata

SEQ ID NO: 39989 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgaatacagtgttttcaat

SEQ ID NO: 39990 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acagtgttttcaatcagcat

SEQ ID NO: 39991 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atcagcattggctgaatcta

SEQ ID NO: 39992 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atctacagatgtaaaaccca

SEQ ID NO: 39993 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agatgtaaaacccacagaca

SEQ ID NO: 39994 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgtaaaacccacagacaca

SEQ ID NO: 39995 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtaaaacccacagacacag

SEQ ID NO: 39996 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aggacaccctgtaattatat

SEQ ID NO: 39997 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtaattatatcagccaaaa

SEQ ID NO: 39998 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttaaataaaaaactgtcac

SEQ ID NO: 39999 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taaataaaaaactgtcacaa

SEQ ID NO: 40000 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaactgtcacaagagaca

SEQ ID NO: 40001 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aactgtcacaagagacaaag

SEQ ID NO: 40002 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actgtcacaagagacaaagt

SEQ ID NO: 40003 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gacaaagtaggtcataaaat

SEQ ID NO: 40004 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taggtcataaaataagataa

SEQ ID NO: 40005 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggtcataaaataagataaaa

SEQ ID NO: 40006 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gataaaagagttaattcatc

SEQ ID NO: 40007 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaagagttaattcatcaag

SEQ ID NO: 40008 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatatgtgaatccatcatca

SEQ ID NO: 40009 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcaaagcatgtaaatacgta

SEQ ID NO: 40010 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atacgtaaagcaatcattga

SEQ ID NO: 40011 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcaatcattgacagatctg

SEQ ID NO: 40012 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcaatcattgacagatctga

SEQ ID NO: 40013 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caatcattgacagatctgaa

SEQ ID NO: 40014 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gatctgaagggataaacatg

SEQ ID NO: 40015 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacatgcagcaacaccataa

SEQ ID NO: 40016 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgcagcaacaccataacag

SEQ ID NO: 40017 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgcagcaacaccataacagt

SEQ ID NO: 40018 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acccgacttgcaataatgaa

SEQ ID NO: 40019 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acttgcaataatgaacagaa

SEQ ID NO: 40020 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcaataatgaacagaacagc

SEQ ID NO: 40021 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgaacagaacagccagata

SEQ ID NO: 40022 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggaatctataaacaaactg

SEQ ID NO: 40023 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtggatttgaacaacgcta

SEQ ID NO: 40024 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaacaacgctatagaccaaa

SEQ ID NO: 40025 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccaaatggatcacaaacaca

SEQ ID NO: 40026 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acacagaatatgctacccaa

SEQ ID NO: 40027 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcttaatataccatcttttc

SEQ ID NO: 40028 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
accatcttttcaagtgcgca

SEQ ID NO: 40029 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagtgcgcacagaatattct

SEQ ID NO: 40030 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtgcgcacagaatattctc

SEQ ID NO: 40031 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cgcacagaatattctcagga

SEQ ID NO: 40032 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctcaggatagatcacatat

SEQ ID NO: 40033 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctcaggatagatcacatatc

SEQ ID NO: 40034 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agatcacatatcaggtcatg

SEQ ID NO: 40035 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agtttgttttgacaactgtt

SEQ ID NO: 40036 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgttttgacaactgttaag

SEQ ID NO: 40037 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttaagaagttgaaatcatac

SEQ ID NO: 40038 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gatatcttttatgaccacaa

SEQ ID NO: 40039 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atcttttatgaccacaatgg

SEQ ID NO: 40040 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcttttatgaccacaatgga

SEQ ID NO: 40041 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgaccacaatggaaggaaac

SEQ ID NO: 40042 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccacaatggaaggaaactgg

SEQ ID NO: 40043 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatggaaggaaactggaagt

SEQ ID NO: 40044 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aggaaactggaagtcagtaa

SEQ ID NO: 40045 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaactggaagtcagtaatag

SEQ ID NO: 40046 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aactggaagtcagtaataga

SEQ ID NO: 40047 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctgaaaaattcacaaatatg

SEQ ID NO: 40048 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaacaacactctcttgaaa

SEQ ID NO: 40049 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acactctcttgaaaaagcaa

SEQ ID NO: 40050 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cactctcttgaaaaagcaat

SEQ ID NO: 40051 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttgaaaaagcaatgggtca

SEQ ID NO: 40052 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggtcaaagaaaaaaaatcaa

SEQ ID NO: 40053 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtcaaagaaaaaaaatcaat

SEQ ID NO: 40054 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatcaataggaaaatttaa

SEQ ID NO: 40055 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttgaaacaaacaaaaatga

SEQ ID NO: 40056 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcacaatttccaaaatttat

SEQ ID NO: 40057 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttccaaaatttatgagatg

SEQ ID NO: 40058 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatttatgagatgcagcaa

SEQ ID NO: 40059 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttatgagatgcagcaaaag

SEQ ID NO: 40060 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcagcaaaagcagtaataa

SEQ ID NO: 40061 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taataaaagcaaatcttatt

SEQ ID NO: 40062 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atacatgtctacattataaa

SEQ ID NO: 40063 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatatctcatataaacaata

SEQ ID NO: 40064 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acaatatagatttacatgtc

SEQ ID NO: 40065 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caatatagatttacatgtct

SEQ ID NO: 40066 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agatttacatgtctaggaac

SEQ ID NO: 40067 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acatgtctaggaactagaaa

SEQ ID NO: 40068 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aactagaaaaagaacaaact

SEQ ID NO: 40069 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaacaaactaagcccaacat

SEQ ID NO: 40070 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actaagcccaacatcagcaa

SEQ ID NO: 40071 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctaagcccaacatcagcaaa

SEQ ID NO: 40072 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcccaacatcagcaaaagg

SEQ ID NO: 40073 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcccaacatcagcaaaagga

SEQ ID NO: 40074 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcaaaaggaaggaaataat

SEQ ID NO: 40075 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aggaaggaaataataagtat

SEQ ID NO: 40076 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaaggaaataataagtatta

SEQ ID NO: 40077 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaataataagtattagagct

SEQ ID NO: 40078 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aataagtattagagctaagt

SEQ ID NO: 40079 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttagagctaagtaagtgaaa

SEQ ID NO: 40080 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agagctaagtaagtgaaata

SEQ ID NO: 40081 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagtgaaatagagaataaaa

SEQ ID NO: 40082 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatagagaataaaaaagcaa

SEQ ID NO: 40083 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaataaaaaagcaatagaaa

SEQ ID NO: 40084 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagaaaaagtcaacaaaact

SEQ ID NO: 40085 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagtcaacaaaactaagaat

SEQ ID NO: 40086 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctaagaattggttttttcga

SEQ ID NO: 40087 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggttttttcgaaagataaaa

SEQ ID NO: 40088 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agataaaatagacaaatcct

SEQ ID NO: 40089 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaatagacaaatccttagc

SEQ ID NO: 40090 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatccttagcaagcataact

SEQ ID NO: 40091 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcaagcataactaagaaaa

SEQ ID NO: 40092 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agcataactaagaaaaaaga

SEQ ID NO: 40093 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cataactaagaaaaaagata

SEQ ID NO: 40094 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ataactaagaaaaaagatag

SEQ ID NO: 40095 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aggactcaaatatgtaaaac

SEQ ID NO: 40096 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatgtaaaaccagaaatga

SEQ ID NO: 40097 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgtaaaaccagaaatgaaa

SEQ ID NO: 40098 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtaaaaccagaaatgaaag

SEQ ID NO: 40099 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taaaaccagaaatgaaagag

SEQ ID NO: 40100 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agaatttacaactgatttta

SEQ ID NO: 40101 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaatttacaactgattttat

SEQ ID NO: 40102 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acaactgattttatgggaat

SEQ ID NO: 40103 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actgattttatgggaataag

SEQ ID NO: 40104 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctgattttatgggaataaga

SEQ ID NO: 40105 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatgggaataagaaggatca

SEQ ID NO: 40106 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgggaataagaaggatcaaa

SEQ ID NO: 40107 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaattatacaccaacaaat

SEQ ID NO: 40108 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caccaacaaattggataact

SEQ ID NO: 40109 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caacaaattggataacttag

SEQ ID NO: 40110 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aacaaattggataacttaga

SEQ ID NO: 40111 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attggataacttagaaggaa

SEQ ID NO: 40112 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttggataacttagaaggaat

SEQ ID NO: 40113 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccaaaaatatacaacctacc

SEQ ID NO: 40114 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acctaccaagactgaatcat

SEQ ID NO: 40115 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cctaccaagactgaatcatg

SEQ ID NO: 40116 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagactgaatcatgaggaaa

SEQ ID NO: 40117 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaggaaatagaataactgaa

SEQ ID NO: 40118 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aataataataatgataatga

SEQ ID NO: 40119 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgatagtaactcccaaaa

SEQ ID NO: 40120 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actcccaaaaaagaaatgta

SEQ ID NO: 40121 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctcccaaaaaagaaatgtac

SEQ ID NO: 40122 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaaaagaaatgtacaggac

SEQ ID NO: 40123 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aagaaatgtacaggaccaga

SEQ ID NO: 40124 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaggaccagacggcttctc

SEQ ID NO: 40125 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aggaccagacggcttctctg

SEQ ID NO: 40126 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
accagacggcttctctggag

SEQ ID NO: 40127 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaagtccaaccaaacattta

SEQ ID NO: 40128 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtccaaccaaacatttaaag

SEQ ID NO: 40129 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaactctcttaaaactttg

SEQ ID NO: 40130 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aactctcttaaaactttgaa

SEQ ID NO: 40131 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actctcttaaaactttgaag

SEQ ID NO: 40132 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcttaaaactttgaagagga

SEQ ID NO: 40133 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagaggaaagaacacttcga

SEQ ID NO: 40134 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acacttcgaaagtcatttta

SEQ ID NO: 40135 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cacttcgaaagtcattttat

SEQ ID NO: 40136 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acttcgaaagtcattttatg

SEQ ID NO: 40137 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cgaaagtcattttatggggc

SEQ ID NO: 40138 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccagaattattctcatatca

SEQ ID NO: 40139 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aattattctcatatcaaagc

SEQ ID NO: 40140 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctcatatcaaagccagaca

SEQ ID NO: 40141 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagccagacaaagacactgt

SEQ ID NO: 40142 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agacaaagacactgtaagaa

SEQ ID NO: 40143 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actgtaagaaaagaaaatta

SEQ ID NO: 40144 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagaaaattacagcttttg

SEQ ID NO: 40145 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagaaaattacagcttttga

SEQ ID NO: 40146 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaattacagcttttgaagg

SEQ ID NO: 40147 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcttttgaaggaagtgactt

SEQ ID NO: 40148 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagtgacttcagcaacattg

SEQ ID NO: 40149 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acttcagcaacattgtggaa

SEQ ID NO: 40150 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttcagcaacattgtggaat

SEQ ID NO: 40151 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcagcaacattgtggaatag

SEQ ID NO: 40152 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagcaacattgtggaatagg

SEQ ID NO: 40153 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatgactattttttctctca

SEQ ID NO: 40154 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttctctcatggacgtacc

SEQ ID NO: 40155 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtaaacatctacatacaca

SEQ ID NO: 40156 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acatctacatacacatggat

SEQ ID NO: 40157 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acacatggatcagttctctc

SEQ ID NO: 40158 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acatggatcagttctctcca

SEQ ID NO: 40159 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagttctctccagagaaacc

SEQ ID NO: 40160 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctccagagaaacccagaatc

SEQ ID NO: 40161 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagagaaacccagaatccag

SEQ ID NO: 40162 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtagaaaaactcatgcacac

SEQ ID NO: 40163 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaaaaactcatgcacacca

SEQ ID NO: 40164 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaaaactcatgcacaccag

SEQ ID NO: 40165 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aactcatgcacaccagagga

SEQ ID NO: 40166 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agaaaatacccatatcaaaa

SEQ ID NO: 40167 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaaaatacccatatcaaaat

SEQ ID NO: 40168 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatacccatatcaaaatggg

SEQ ID NO: 40169 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catatcaaaatgggtagaaa

SEQ ID NO: 40170 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atcaaaatgggtagaaaaag

SEQ ID NO: 40171 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatgggtagaaaaagtgga

SEQ ID NO: 40172 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcatgcactaaccccaccct

SEQ ID NO: 40173 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cactaaccccaccctgagca

SEQ ID NO: 40174 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgagcacagtgccttacatt

SEQ ID NO: 40175 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gagcacagtgccttacattt

SEQ ID NO: 40176 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cacagtgccttacatttggg

SEQ ID NO: 40177 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgggaagaaaaccaaatttg

SEQ ID NO: 40178 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaatttgcagctacttccc

SEQ ID NO: 40179 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaatttgcagctacttccca

SEQ ID NO: 40180 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aatttgcagctacttcccaa

SEQ ID NO: 40181 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcagctacttcccaagggtt

SEQ ID NO: 40182 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcccaagggttgagaaacta

SEQ ID NO: 40183 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagaaactatagcacacata

SEQ ID NO: 40184 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acccaacttttttttaattt

SEQ ID NO: 40185 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccaacttttttttaattta

SEQ ID NO: 40186 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaggaaatgtatttatttc

SEQ ID NO: 40187 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttctagaaaatgctttttc

SEQ ID NO: 40188 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctagaaaatgctttttcta

SEQ ID NO: 40189 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgctttttctagagtgta

SEQ ID NO: 40190 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgctttttctagagtgtaaa

SEQ ID NO: 40191 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctttttctagagtgtaaaga

SEQ ID NO: 40192 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttctagagtgtaaagagag

SEQ ID NO: 40193 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctagagtgtaaagagagaa

SEQ ID NO: 40194 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatcatcttcataattgcct

SEQ ID NO: 40195 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgccttggttttccattttg

SEQ ID NO: 40196 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttgtagaacccaactttta

SEQ ID NO: 40197 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgtagaacccaacttttat

SEQ ID NO: 40198 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacttttataggccctgaca

SEQ ID NO: 40199 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cttttataggccctgacaca

SEQ ID NO: 40200 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ataggccctgacacagagct

SEQ ID NO: 40201 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgacacagagcttggcttt

SEQ ID NO: 40202 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcttttagatcaccatgctt

SEQ ID NO: 40203 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttttagatcaccatgcttg

SEQ ID NO: 40204 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agatcaccatgcttgaggaa

SEQ ID NO: 40205 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcaccatgcttgaggaatgg

SEQ ID NO: 40206 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
accatgcttgaggaatggca

SEQ ID NO: 40207 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcttgaggaatggcagagat

SEQ ID NO: 40208 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaatggcagagataagccat

SEQ ID NO: 40209 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atggcagagataagccattg

SEQ ID NO: 40210 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agccattggagttttctctc

SEQ ID NO: 40211 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctctcaagtacaaaaaacga

SEQ ID NO: 40212 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tctcaagtacaaaaaacgat

SEQ ID NO: 40213 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctcaagtacaaaaaacgatg

SEQ ID NO: 40214 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcaagtacaaaaaacgatgg

SEQ ID NO: 40215 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caagtacaaaaaacgatggg

SEQ ID NO: 40216 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggggggttttgaactgcct

SEQ ID NO: 40217 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgaactgcctgagcactct

SEQ ID NO: 40218 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aactgcctgagcactctcag

SEQ ID NO: 40219 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctctcagaagctttaattcc

SEQ ID NO: 40220 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tctcagaagctttaattcct

SEQ ID NO: 40221 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaagctttaattcctgggat

SEQ ID NO: 40222 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
accatcttccaacttcccca

SEQ ID NO: 40223 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aacttccccatggaaaccat

SEQ ID NO: 40224 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acttccccatggaaaccatt

SEQ ID NO: 40225 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccattaggctacacgttttc

SEQ ID NO: 40226 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgttttccagccgctccctg

SEQ ID NO: 40227 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccagccgctccctgtggttc

SEQ ID NO: 40228 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cctgtggttctggcctcttc

SEQ ID NO: 40229 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttctggcctcttccagtact

SEQ ID NO: 40230 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccagtacttggaaatctaca

SEQ ID NO: 40231 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggaaatctacatagcaaatg

SEQ ID NO: 40232 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatgaagaataaaccttctt

SEQ ID NO: 40233 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaccttcttcagcctaaac

SEQ ID NO: 40234 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
accttcttcagcctaaacaa

SEQ ID NO: 40235 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccttcttcagcctaaacaag

SEQ ID NO: 40236 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attccccacgccttcttccc

SEQ ID NO: 40237 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccttcttccctggcttcctc

SEQ ID NO: 40238 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttcttccctggcttcctcca

SEQ ID NO: 40239 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttttttttttttttttttt

SEQ ID NO: 40240 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttttttttttttttttgaga

SEQ ID NO: 40241 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttttttttttttttgagatg

SEQ ID NO: 40242 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cgctgtctcgctctgtcgcc

SEQ ID NO: 40243 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gctgtctcgctctgtcgccc

SEQ ID NO: 40244 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctcgctctgtcgcccaggc

SEQ ID NO: 40245 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcgctctgtcgcccaggctg

SEQ ID NO: 40246 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgtcgcccaggctggagtg

SEQ ID NO: 40247 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcgcccaggctggagtgcag

SEQ ID NO: 40248 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ggagtgcagtggcgcaatct

SEQ ID NO: 40249 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcgcaatctcggctcactgc

SEQ ID NO: 40250 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tcactgcaagctccgcctcc

SEQ ID NO: 40251 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cactgcaagctccgcctccc

SEQ ID NO: 40252 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcatgccattctcctgcct

SEQ ID NO: 40253 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttctcctgcctcagcctccc

SEQ ID NO: 40254 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcctgcctcagcctcccgag

SEQ ID NO: 40255 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcctcagcctcccgagtagc

SEQ ID NO: 40256 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctcagcctcccgagtagct

SEQ ID NO: 40257 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcccgagtagctgggacta

SEQ ID NO: 40258 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcccgagtagctgggactac

SEQ ID NO: 40259 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
caggcgcccgctaccacgcc

SEQ ID NO: 40260 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cggctaattttttgtatttt

SEQ ID NO: 40261 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctaattttttgtatttttag

SEQ ID NO: 40262 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aattttttgtatttttagta

SEQ ID NO: 40263 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ttttgtatttttagtagaga

SEQ ID NO: 40264 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttgtatttttagtagagac

SEQ ID NO: 40265 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttgtatttttagtagagacg

SEQ ID NO: 40266 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagacggggtttcaccgtgt

SEQ ID NO: 40267 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cggggtttcaccgtgttagc

SEQ ID NO: 40268 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggggtttcaccgtgttagcc

SEQ ID NO: 40269 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttcaccgtgttagccagga

SEQ ID NO: 40270 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
acctcgtgatccgcccgcct

SEQ ID NO: 40271 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccgcccgcctcggcctccca

SEQ ID NO: 40272 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcctcggcctcccaaagtgc

SEQ ID NO: 40273 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctcggcctcccaaagtgct

SEQ ID NO: 40274 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcccaaagtgctgggatta

SEQ ID NO: 40275 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcccaaagtgctgggattac

SEQ ID NO: 40276 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtgctgggattacaggcgt

SEQ ID NO: 40277 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
caggcgtgagccaccgcgcc

SEQ ID NO: 40278 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggccacaatctttcttttaa

SEQ ID NO: 40279 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatctttcttttaaaagatg

SEQ ID NO: 40280 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctttcttttaaaagatgtgg

SEQ ID NO: 40281 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttcttttaaaagatgtgga

SEQ ID NO: 40282 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtggaaggtctctaccacc

SEQ ID NO: 40283 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaggtctctaccaccaagaa

SEQ ID NO: 40284 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aggtctctaccaccaagaac

SEQ ID NO: 40285 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctctaccaccaagaacagg

SEQ ID NO: 40286 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctctaccaccaagaacagga

SEQ ID NO: 40287 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taccaccaagaacaggaagg

SEQ ID NO: 40288 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caggaaggtggcttcttccc

SEQ ID NO: 40289 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgctcctgacataatttatg

SEQ ID NO: 40290 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taatttatgcagtttcttat

SEQ ID NO: 40291 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atttatgcagtttcttatta

SEQ ID NO: 40292 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttatgcagtttcttattag

SEQ ID NO: 40293 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgcagtttcttattagagg

SEQ ID NO: 40294 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgcagtttcttattagagga

SEQ ID NO: 40295 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgaactacactttaatccaa

SEQ ID NO: 40296 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctttaatccaatagatctaa

SEQ ID NO: 40297 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atagatctaacagatattta

SEQ ID NO: 40298 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctaacagatatttatagaa

SEQ ID NO: 40299 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttatagaacagttcatccaa

SEQ ID NO: 40300 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaatcacatgaaacactctc

SEQ ID NO: 40301 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatcacatgaaacactctcc

SEQ ID NO: 40302 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acatgaaacactctccagga

SEQ ID NO: 40303 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctccaggatagatcacatgt

SEQ ID NO: 40304 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tccaggatagatcacatgtt

SEQ ID NO: 40305 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cacatgttaggccaccaaac

SEQ ID NO: 40306 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaacaagttttaacaaattt

SEQ ID NO: 40307 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caagttttaacaaatttaag

SEQ ID NO: 40308 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagaagattaaaatcatatc

SEQ ID NO: 40309 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgttcatgatgacatgaaac

SEQ ID NO: 40310 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcatgatgacatgaaactag

SEQ ID NO: 40311 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acatgaaactagaagtcaat

SEQ ID NO: 40312 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgaacaactcataattacg

SEQ ID NO: 40313 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttaaacaacatgctcctgaa

SEQ ID NO: 40314 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taaacaacatgctcctgaac

SEQ ID NO: 40315 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acatgctcctgaacaggcaa

SEQ ID NO: 40316 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
catgctcctgaacaggcaat

SEQ ID NO: 40317 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cctgaacaggcaatgggtca

SEQ ID NO: 40318 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaacaggcaatgggtcaaag

SEQ ID NO: 40319 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gggtcaaagaagaaattata

SEQ ID NO: 40320 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaagaaattatacggaaaaa

SEQ ID NO: 40321 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cggaaaaacagaaaatattt

SEQ ID NO: 40322 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggaaaaacagaaaatatttt

SEQ ID NO: 40323 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tattttgggatcaatgacaa

SEQ ID NO: 40324 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atcaatgacaatggaaacac

SEQ ID NO: 40325 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tggaaacacaagataacaaa

SEQ ID NO: 40326 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acacaagataacaaatagta

SEQ ID NO: 40327 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ataacaaatagtatggaatg

SEQ ID NO: 40328 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatagtatggaatgtagaaa

SEQ ID NO: 40329 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agtatggaatgtagaaaaag

SEQ ID NO: 40330 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatgtagaaaaagaagccct

SEQ ID NO: 40331 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtagaaaaagaagccctga

SEQ ID NO: 40332 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agccctgagagaaaaattta

SEQ ID NO: 40333 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agtaataaatgcctacatta

SEQ ID NO: 40334 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataaatgcctacattaaaga

SEQ ID NO: 40335 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgcctacattaaagaaag

SEQ ID NO: 40336 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgcctacattaaagaaaga

SEQ ID NO: 40337 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aacaacctaatattacatct

SEQ ID NO: 40338 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caacctaatattacatctta

SEQ ID NO: 40339 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taatattacatcttagagat

SEQ ID NO: 40340 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacatcttagagattagaaa

SEQ ID NO: 40341 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atcttagagattagaaaaag

SEQ ID NO: 40342 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agagattagaaaaagaagaa

SEQ ID NO: 40343 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagaatatccccaaactttg

SEQ ID NO: 40344 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatatccccaaactttgcag

SEQ ID NO: 40345 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atatccccaaactttgcaga

SEQ ID NO: 40346 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tccccaaactttgcagaagg

SEQ ID NO: 40347 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcagaaggaagaaaataaca

SEQ ID NO: 40348 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaaaataacaaagataatga

SEQ ID NO: 40349 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gataatgatagaaataaaca

SEQ ID NO: 40350 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaacaaagcaaatactaaa

SEQ ID NO: 40351 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaaagttgtttttttgaa

SEQ ID NO: 40352 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaatcgaaaaacctttaac

SEQ ID NO: 40353 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacctttaactagactaacc

SEQ ID NO: 40354 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acctttaactagactaacca

SEQ ID NO: 40355 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctttaactagactaaccaa

SEQ ID NO: 40356 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctagactaaccaagggaaaa

SEQ ID NO: 40357 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcaaacaatatctgaaatga

SEQ ID NO: 40358 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacaatatctgaaatgaaag

SEQ ID NO: 40359 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acaatatctgaaatgaaaga

SEQ ID NO: 40360 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caatatctgaaatgaaagaa

SEQ ID NO: 40361 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atatctgaaatgaaagaagg

SEQ ID NO: 40362 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cactgataacacataaatac

SEQ ID NO: 40363 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actgataacacataaataca

SEQ ID NO: 40364 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caccatcaaattgaataacc

SEQ ID NO: 40365 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catcaaattgaataacctag

SEQ ID NO: 40366 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atcaaattgaataacctaga

SEQ ID NO: 40367 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agaaggaatgaactaatctt

SEQ ID NO: 40368 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttagaaacatgcaacctacc

SEQ ID NO: 40369 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caacctaccaagactaaatc

SEQ ID NO: 40370 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acatctgaacaaaccaatac

SEQ ID NO: 40371 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaacaaaccaatactggata

SEQ ID NO: 40372 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccaatactggataaagaaaa

SEQ ID NO: 40373 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actggataaagaaaatagat

SEQ ID NO: 40374 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatagatcagtaataaatt

SEQ ID NO: 40375 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcctaaccaaaaaaaaaaaa

SEQ ID NO: 40376 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cctaaccaaaaaaaaaaaaa

SEQ ID NO: 40377 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccaaaaaaaaaaaaaaggaa

SEQ ID NO: 40378 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caaaaaaaaaaaaaaggaaa

SEQ ID NO: 40379 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaaaaaaggaaaaggtcac

SEQ ID NO: 40380 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcactggtgaattctattta

SEQ ID NO: 40381 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctggtgaattctatttaaag

SEQ ID NO: 40382 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattcttccaaaaaattgaa

SEQ ID NO: 40383 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attcttccaaaaaattgaaa

SEQ ID NO: 40384 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcttccaaaaaattgaaaag

SEQ ID NO: 40385 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttccaaaaaattgaaaagg

SEQ ID NO: 40386 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggaggtcaaattcattttat

SEQ ID NO: 40387 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaggtcaaattcattttatg

SEQ ID NO: 40388 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcaaattcattttatgaggc

SEQ ID NO: 40389 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatactgatatgaaaaccct

SEQ ID NO: 40390 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tactgatatgaaaaccctaa

SEQ ID NO: 40391 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaccctaagagtatgctac

SEQ ID NO: 40392 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctaagagtatgctaccagaa

SEQ ID NO: 40393 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gctaccagaaaagaaaactg

SEQ ID NO: 40394 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctaccagaaaagaaaactgc

SEQ ID NO: 40395 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gccaatattcttgatgaaca

SEQ ID NO: 40396 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaaattcacaacaatatat

SEQ ID NO: 40397 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tattagcaaactgaattccc

SEQ ID NO: 40398 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catcattcaccatgattact

SEQ ID NO: 40399 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atcattcaccatgattactt

SEQ ID NO: 40400 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgattacttgggatttatct

SEQ ID NO: 40401 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gattacttgggatttatctg

SEQ ID NO: 40402 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
attacttgggatttatctga

SEQ ID NO: 40403 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttatctgagggatgcaaaaa

SEQ ID NO: 40404 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatgctacattaacaaaat

SEQ ID NO: 40405 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatcatatgatcatcttac

SEQ ID NO: 40406 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatgatcatcttactagatg

SEQ ID NO: 40407 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catcttactagatgcagaca

SEQ ID NO: 40408 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acaaagcatttgataaaatc

SEQ ID NO: 40409 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcataataaaatctcaaca

SEQ ID NO: 40410 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ataataaaatctcaacaaag

SEQ ID NO: 40411 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaatctcaacaaagcagata

SEQ ID NO: 40412 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctcaacaaagcagatatgg

SEQ ID NO: 40413 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctcaacaaagcagatatgga

SEQ ID NO: 40414 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaatgtaccttaacaaaata

SEQ ID NO: 40415 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaataaagccatatatgac

SEQ ID NO: 40416 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
agccatatatgacaagccca

SEQ ID NO: 40417 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacattatgcaaaaactgaa

SEQ ID NO: 40418 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttatgcaaaaactgaaaagt

SEQ ID NO: 40419 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tatgcaaaaactgaaaagtt

SEQ ID NO: 40420 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgcaaaaactgaaaagttgg

SEQ ID NO: 40421 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagttgggagcttttcttct

SEQ ID NO: 40422 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gggagcttttcttctaagat

SEQ ID NO: 40423 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggagcttttcttctaagatc

SEQ ID NO: 40424 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttcttctaagatcaggaac

SEQ ID NO: 40425 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctaagatcaggaacaagac

SEQ ID NO: 40426 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctaagatcaggaacaagaca

SEQ ID NO: 40427 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attaccacttctttttgaca

SEQ ID NO: 40428 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acttctttttgacatagtac

SEQ ID NO: 40429 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtactagaaatcccatcca

SEQ ID NO: 40430 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaaatcccatccatagcaat

SEQ ID NO: 40431 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaatcccatccatagcaatt

SEQ ID NO: 40432 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcccatccatagcaattagg

SEQ ID NO: 40433 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccatccatagcaattaggc

SEQ ID NO: 40434 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catagcaattaggcaggaaa

SEQ ID NO: 40435 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaataaaatacatccatgt

SEQ ID NO: 40436 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaatacatccatgtaaga

SEQ ID NO: 40437 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atacatccatgtaagaaagc

SEQ ID NO: 40438 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatgacatgatctttatatg

SEQ ID NO: 40439 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaaccctgaacactctact

SEQ ID NO: 40440 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttaaaactgatacataaatt

SEQ ID NO: 40441 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actgatacataaattcagta

SEQ ID NO: 40442 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acataaattcagtaaagttg

SEQ ID NO: 40443 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgcagtttgcaaaatcaaca

SEQ ID NO: 40444 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caaaatcaacatagaaaaat

SEQ ID NO: 40445 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatcaacatagaaaaatcag

SEQ ID NO: 40446 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
catttctatacattaacaat

SEQ ID NO: 40447 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atttctatacattaacaatg

SEQ ID NO: 40448 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taacaatgaggtatccaaca

SEQ ID NO: 40449 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggtatccaacaaagaaatt

SEQ ID NO: 40450 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaaattaatcctatttaaaa

SEQ ID NO: 40451 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaataaataaaatactttg

SEQ ID NO: 40452 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tactttgaagtaaatttaac

SEQ ID NO: 40453 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actttgaagtaaatttaacc

SEQ ID NO: 40454 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaagtaaatttaaccagga

SEQ ID NO: 40455 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatttaaccaggaaagttg

SEQ ID NO: 40456 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atctgtacactgaaaactat

SEQ ID NO: 40457 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taagttgatttaaaaaaact

SEQ ID NO: 40458 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagttgatttaaaaaaactg

SEQ ID NO: 40459 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgatttaaaaaaactgagg

SEQ ID NO: 40460 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatatttcatgttcatgtgt

SEQ ID NO: 40461 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atttcatgttcatgtgttgg

SEQ ID NO: 40462 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atactacccaaaataatcta

SEQ ID NO: 40463 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccctatcaaaattctaatgt

SEQ ID NO: 40464 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aattctaatgtcagttttca

SEQ ID NO: 40465 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatgtcagttttcacagaaa

SEQ ID NO: 40466 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacatttgaataaaataaaa

SEQ ID NO: 40467 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaataaaaaagatgctaaa

SEQ ID NO: 40468 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaagatgctaaatggcca

SEQ ID NO: 40469 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctaaatggccaaagcaatct

SEQ ID NO: 40470 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gccaaagcaatctgagcaaa

SEQ ID NO: 40471 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caatctgagcaaaaagaaca

SEQ ID NO: 40472 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgagcaaaaagaacaaagc

SEQ ID NO: 40473 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gagcaaaaagaacaaagcta

SEQ ID NO: 40474 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agcaaaaagaacaaagctag

SEQ ID NO: 40475 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctctgtcatttcaaaatata

SEQ ID NO: 40476 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaatataaagctatgctat

SEQ ID NO: 40477 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctatgctattggcataaaca

SEQ ID NO: 40478 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggcataaacacagatatat

SEQ ID NO: 40479 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aacacagatatattggctaa

SEQ ID NO: 40480 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agatatattggctaatggaa

SEQ ID NO: 40481 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gatatattggctaatggaaa

SEQ ID NO: 40482 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggctaatggaaaaggataaa

SEQ ID NO: 40483 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atggaaaaggataaaaagcc

SEQ ID NO: 40484 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaaataaacccaattattta

SEQ ID NO: 40485 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atttatagtcaattgatttt

SEQ ID NO: 40486 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagtcaattgattttcagca

SEQ ID NO: 40487 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtcaattgattttcagcaa

SEQ ID NO: 40488 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgattttcagcaaaggtgca

SEQ ID NO: 40489 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaggtgcaaagaataaacaa

SEQ ID NO: 40490 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aggtgcaaagaataaacaat

SEQ ID NO: 40491 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggtgcaaagaataaacaatg

SEQ ID NO: 40492 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtgcaaagaataaacaatgg

SEQ ID NO: 40493 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagaataaacaatggggga

SEQ ID NO: 40494 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagaataaacaatgggggaa

SEQ ID NO: 40495 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aggacgatctcttcaataaa

SEQ ID NO: 40496 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atctcttcaataaatggtgt

SEQ ID NO: 40497 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tctcttcaataaatggtgtt

SEQ ID NO: 40498 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actgaatattccttatgcaa

SEQ ID NO: 40499 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cttatgcaaaagaatgaaat

SEQ ID NO: 40500 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttatgcaaaagaatgaaatt

SEQ ID NO: 40501 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatgtttataaaaccaaac

SEQ ID NO: 40502 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttataaaaccaaacaagtaa

SEQ ID NO: 40503 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caagtaaaagacttaaatat

SEQ ID NO: 40504 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atataagaaatgaaactata

SEQ ID NO: 40505 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatgaaactataaagctac

SEQ ID NO: 40506 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaaactataaagctactag

SEQ ID NO: 40507 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gctactagaagaaaacataa

SEQ ID NO: 40508 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagaagaaaacataaaagaa

SEQ ID NO: 40509 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaagctgtatgacatttatc

SEQ ID NO: 40510 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aagctgtatgacatttatct

SEQ ID NO: 40511 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtatgacatttatctgggc

SEQ ID NO: 40512 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtatgacatttatctgggca

SEQ ID NO: 40513 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttatctgggcaaggatttct

SEQ ID NO: 40514 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgggcaaggatttcttggc

SEQ ID NO: 40515 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgggcaaggatttcttggct

SEQ ID NO: 40516 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttcttggctaggactctaa

SEQ ID NO: 40517 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tggctaggactctaaaagca

SEQ ID NO: 40518 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggctaggactctaaaagcac

SEQ ID NO: 40519 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctaaaagcacaggtaacaa

SEQ ID NO: 40520 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cacaggtaacaaaagacaat

SEQ ID NO: 40521 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caggtaacaaaagacaataa

SEQ ID NO: 40522 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacaaaagacaataagagac

SEQ ID NO: 40523 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaagacaataagagacaagt

SEQ ID NO: 40524 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caataagagacaagttggat

SEQ ID NO: 40525 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caaactaaaaatgttcttta

SEQ ID NO: 40526 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgttctttacagcaaacg

SEQ ID NO: 40527 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tacagcaaacgaagcaataa

SEQ ID NO: 40528 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagcaaacgaagcaataaca

SEQ ID NO: 40529 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caaacgaagcaataacagag

SEQ ID NO: 40530 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aacgaagcaataacagagtg

SEQ ID NO: 40531 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cgaagcaataacagagtgga

SEQ ID NO: 40532 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagcaataacagagtggaga

SEQ ID NO: 40533 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcaataacagagtggagaga

SEQ ID NO: 40534 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cagagtggagagagagatca

SEQ ID NO: 40535 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcaaaccatacatctgata

SEQ ID NO: 40536 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcaaaccatacatctgataa

SEQ ID NO: 40537 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caaaccatacatctgataaa

SEQ ID NO: 40538 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatccaacattatacataaa

SEQ ID NO: 40539 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acattatacataaaaagctc

SEQ ID NO: 40540 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agctcaagcaactcaacacc

SEQ ID NO: 40541 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaaaatcaataaaccaattg

SEQ ID NO: 40542 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcaataaaccaattgtagaa

SEQ ID NO: 40543 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caataaaccaattgtagaat

SEQ ID NO: 40544 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaatgggcaaataatctgaa

SEQ ID NO: 40545 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctgaacagacatttctcaa

SEQ ID NO: 40546 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaacagacatttctcaaaag

SEQ ID NO: 40547 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acagacatttctcaaaagaa

SEQ ID NO: 40548 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctcaaaagaagagatatgaa

SEQ ID NO: 40549 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaagagatatgaatggccaa

SEQ ID NO: 40550 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgctcaacatctctaatcat

SEQ ID NO: 40551 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatattacctcacacctcc

SEQ ID NO: 40552 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttacctcacacctcctagaa

SEQ ID NO: 40553 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctagaatggctgttatcaaa

SEQ ID NO: 40554 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcaaaaagatgaatgataac

SEQ ID NO: 40555 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaatgataacaagtgttgat

SEQ ID NO: 40556 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatgataacaagtgttgatg

SEQ ID NO: 40557 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aacaagtgttgatgaggatg

SEQ ID NO: 40558 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caagtgttgatgaggatgtg

SEQ ID NO: 40559 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgatgaggatgtggagaaa

SEQ ID NO: 40560 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgatgaggatgtggagaaat

SEQ ID NO: 40561 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taggaacccttatacattgt

SEQ ID NO: 40562 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgttagtgaaaatgtaaat

SEQ ID NO: 40563 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtgaaaatgtaaattagta

SEQ ID NO: 40564 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtaaattagtacagctgttt

SEQ ID NO: 40565 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtacagctgtttgagaaaaa

SEQ ID NO: 40566 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gctgtttgagaaaaatagca

SEQ ID NO: 40567 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtttgagaaaaatagcatgg

SEQ ID NO: 40568 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatacaattaccatataatt

SEQ ID NO: 40569 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taattcagcaattccacttc

SEQ ID NO: 40570 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aattcagcaattccacttct

SEQ ID NO: 40571 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caattccacttctaggtata

SEQ ID NO: 40572 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttccacttctaggtatatag

SEQ ID NO: 40573 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tggtatatatttaattcctt

SEQ ID NO: 40574 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtatatatttaattccttta

SEQ ID NO: 40575 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatatatttaattcctttag

SEQ ID NO: 40576 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaattaaaatcgttctgtca

SEQ ID NO: 40577 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aattaaaatcgttctgtcaa

SEQ ID NO: 40578 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgcactcccatgttcattt

SEQ ID NO: 40579 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcatttcagcattatttac

SEQ ID NO: 40580 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagcattatttacaagaacc

SEQ ID NO: 40581 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttacaagaaccaagacatat

SEQ ID NO: 40582 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tacaagaaccaagacatatt

SEQ ID NO: 40583 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agaaccaagacatattaggt

SEQ ID NO: 40584 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggttggtgcaaatgtaattg

SEQ ID NO: 40585 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attacttttgctgcaattaa

SEQ ID NO: 40586 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttgctgcaattaaaagtaa

SEQ ID NO: 40587 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgcaacctgtacccatcaa

SEQ ID NO: 40588 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgcaacctgtacccatcaac

SEQ ID NO: 40589 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catcaacaggtgaatgaata

SEQ ID NO: 40590 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatgaataaagaaaatgtga

SEQ ID NO: 40591 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgaataaagaaaatgtgat

SEQ ID NO: 40592 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaaaatgtgataggtatgca

SEQ ID NO: 40593 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actactatacaaaactttaa

SEQ ID NO: 40594 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcccaacatgaatgaaacta

SEQ ID NO: 40595 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccaacatgaatgaaactaa

SEQ ID NO: 40596 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaactaaaggacgttatgct

SEQ ID NO: 40597 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gacgttatgctaagcaaaat

SEQ ID NO: 40598 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttatgctaagcaaaattagc

SEQ ID NO: 40599 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatgctaagcaaaattagcc

SEQ ID NO: 40600 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taagcaaaattagccaggta

SEQ ID NO: 40601 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaaattagccaggtacaga

SEQ ID NO: 40602 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gatctcacttacatgtaaaa

SEQ ID NO: 40603 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atctcacttacatgtaaaat

SEQ ID NO: 40604 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tctcacttacatgtaaaatg

SEQ ID NO: 40605 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cacttacatgtaaaatgggg

SEQ ID NO: 40606 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acttacatgtaaaatggggt

SEQ ID NO: 40607 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cttacatgtaaaatggggtg

SEQ ID NO: 40608 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttacatgtaaaatggggtgg

SEQ ID NO: 40609 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tacatgtaaaatggggtggg

SEQ ID NO: 40610 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
catgtaaaatggggtggggg

SEQ ID NO: 40611 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgtaaaatggggtgggggg

SEQ ID NO: 40612 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgtaaaatggggtgggggga

SEQ ID NO: 40613 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtaaaatggggtggggggag

SEQ ID NO: 40614 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taaaatggggtggggggagg

SEQ ID NO: 40615 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaatggggtggggggaggg

SEQ ID NO: 40616 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatggggtggggggaggggg

SEQ ID NO: 40617 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atggggtggggggagggggg

SEQ ID NO: 40618 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tggggtggggggagggggga

SEQ ID NO: 40619 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtggggggaggggggaggga

SEQ ID NO: 40620 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggaggggggagggatagcat

SEQ ID NO: 40621 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaggggggagggatagcatt

SEQ ID NO: 40622 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggggggagggatagcattag

SEQ ID NO: 40623 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atatacctaatgtaaatgac

SEQ ID NO: 40624 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taatgtaaatgacgagttaa

SEQ ID NO: 40625 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aatgtaaatgacgagttaat

SEQ ID NO: 40626 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgggtgccgcacaccaaca

SEQ ID NO: 40627 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cacgttgtgcacatgtaccc

SEQ ID NO: 40628 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cacatgtaccctagaactta

SEQ ID NO: 40629 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaataaataaaaaataaaa

SEQ ID NO: 40630 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taaataaaaaataaaaaagt

SEQ ID NO: 40631 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataaaaaataaaaaagtgag

SEQ ID NO: 40632 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaagtgagaagtcaacatta

SEQ ID NO: 40633 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaagtcaacattacagaaa

SEQ ID NO: 40634 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cattacagaaacagcatata

SEQ ID NO: 40635 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attacagaaacagcatataa

SEQ ID NO: 40636 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acagaaacagcatataaagg

SEQ ID NO: 40637 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcatataaaggtggttgcca

SEQ ID NO: 40638 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catataaaggtggttgccat

SEQ ID NO: 40639 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaggtggttgccataggac

SEQ ID NO: 40640 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaggtggttgccataggact

SEQ ID NO: 40641 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aggtggttgccataggactg

SEQ ID NO: 40642 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggtggttgccataggactgg

SEQ ID NO: 40643 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggttgccataggactggggg

SEQ ID NO: 40644 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aggactgggggaagacgatg

SEQ ID NO: 40645 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gactgggggaagacgatgtg

SEQ ID NO: 40646 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gggggaagacgatgtggaga

SEQ ID NO: 40647 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaagtataaatcttgatca

SEQ ID NO: 40648 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaagtataaatcttgatcaa

SEQ ID NO: 40649 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaggatgtacatttttcatt

SEQ ID NO: 40650 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggatgtacatttttcattta

SEQ ID NO: 40651 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtacatttttcatttagag

SEQ ID NO: 40652 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tacatttttcatttagagta

SEQ ID NO: 40653 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acatttttcatttagagtag

SEQ ID NO: 40654 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agagtagaggaataaatctt

SEQ ID NO: 40655 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagaggaataaatcttaaga

SEQ ID NO: 40656 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataaatcttaagatggatta

SEQ ID NO: 40657 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atctaaaactataaaaaccc

SEQ ID NO: 40658 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaactataaaaaccctgg

SEQ ID NO: 40659 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actataaaaaccctggaaga

SEQ ID NO: 40660 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaaaccctggaagacagcc

SEQ ID NO: 40661 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaaccctggaagacagcct

SEQ ID NO: 40662 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acagcctaggcaataccatt

SEQ ID NO: 40663 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagcctaggcaataccattc

SEQ ID NO: 40664 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aggcaataccattcaggaca

SEQ ID NO: 40665 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggcaataccattcaggacat

SEQ ID NO: 40666 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taccattcaggacataggca

SEQ ID NO: 40667 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
accattcaggacataggcat

SEQ ID NO: 40668 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcaggacataggcatgggca

SEQ ID NO: 40669 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgggcaaagatttcatgatg

SEQ ID NO: 40670 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttcatgatgaagacaccaa

SEQ ID NO: 40671 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caaaaacaaaaattaacaaa

SEQ ID NO: 40672 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaaacaaaaattaacaaat

SEQ ID NO: 40673 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgggatctaattaaacta

SEQ ID NO: 40674 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgggatctaattaaactaaa

SEQ ID NO: 40675 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaactaaagagcttctgca

SEQ ID NO: 40676 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagagcttctgcacagcaa

SEQ ID NO: 40677 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acagcaaaagaaactatcaa

SEQ ID NO: 40678 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agcaaaagaaactatcaaca

SEQ ID NO: 40679 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagaaactatcaacagagt

SEQ ID NO: 40680 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaaactatcaacagagtaag

SEQ ID NO: 40681 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctatcaacagagtaagcaga

SEQ ID NO: 40682 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagagtaagcagacagtcta

SEQ ID NO: 40683 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taagcagacagtctacagaa

SEQ ID NO: 40684 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aagcagacagtctacagaat

SEQ ID NO: 40685 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcagacagtctacagaatgg

SEQ ID NO: 40686 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaatgggagaaaatttttg

SEQ ID NO: 40687 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcagactatgcatctgaca

SEQ ID NO: 40688 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcagactatgcatctgacaa

SEQ ID NO: 40689 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctgacaaaggtctaatatc

SEQ ID NO: 40690 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtctaatatccagaatctat

SEQ ID NO: 40691 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctaatatccagaatctata

SEQ ID NO: 40692 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatctataaggaacttaaat

SEQ ID NO: 40693 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggaacttaaatgagtttac

SEQ ID NO: 40694 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaataaacaaccccattaaa

SEQ ID NO: 40695 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taaacaaccccattaaaaag

SEQ ID NO: 40696 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaacaaccccattaaaaagt

SEQ ID NO: 40697 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
accccattaaaaagtgggca

SEQ ID NO: 40698 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccccattaaaaagtgggcaa

SEQ ID NO: 40699 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagtgggcaaaggatatgaa

SEQ ID NO: 40700 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatgaacagacacttctgaa

SEQ ID NO: 40701 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaacagacacttctgaaaag

SEQ ID NO: 40702 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagacacacatgcaacaaac

SEQ ID NO: 40703 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acaaacaagcatatgaaaaa

SEQ ID NO: 40704 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agctcaatgtcactgaccat

SEQ ID NO: 40705 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctcaatgtcactgaccatta

SEQ ID NO: 40706 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgcaaatcaaaaccacaat

SEQ ID NO: 40707 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatgagataccatctcacac

SEQ ID NO: 40708 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agataccatctcacaccagt

SEQ ID NO: 40709 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccatctcacaccagtcagaa

SEQ ID NO: 40710 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcagaatggctattatgaaa

SEQ ID NO: 40711 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgaaaaagtcaaaaaataa

SEQ ID NO: 40712 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtcaaaaaataacagatgc

SEQ ID NO: 40713 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaaaataacagatgctggc

SEQ ID NO: 40714 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaaataacagatgctggcg

SEQ ID NO: 40715 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaataacagatgctggcga

SEQ ID NO: 40716 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aacagatgctggcgagggtg

SEQ ID NO: 40717 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagatgctggcgagggtgtg

SEQ ID NO: 40718 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggcgagggtgtggagaaaaa

SEQ ID NO: 40719 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaatgcctacacactgttga

SEQ ID NO: 40720 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aatgcctacacactgttgat

SEQ ID NO: 40721 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgcctacacactgttgatgg

SEQ ID NO: 40722 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtaaattaattcaaccataa

SEQ ID NO: 40723 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattaattcaaccataatgg

SEQ ID NO: 40724 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaccataatggaagactgtg

SEQ ID NO: 40725 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gactgtgtggcaattcctca

SEQ ID NO: 40726 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggcaattcctcaaagaccta

SEQ ID NO: 40727 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attcctcaaagacctaaaga

SEQ ID NO: 40728 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gacagaaatgccattcaacc

SEQ ID NO: 40729 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caacccagcaatcccattac

SEQ ID NO: 40730 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aacccagcaatcccattact

SEQ ID NO: 40731 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cattactgggtatataccta

SEQ ID NO: 40732 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attactgggtatatacctaa

SEQ ID NO: 40733 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttactgggtatatacctaaa

SEQ ID NO: 40734 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatacatttttctattata

SEQ ID NO: 40735 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acatgcacacatatgtttat

SEQ ID NO: 40736 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgcacacatatgtttattg

SEQ ID NO: 40737 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tattggagcactattcacaa

SEQ ID NO: 40738 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagcactattcacaatggca

SEQ ID NO: 40739 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tattcacaatggcaaagaca

SEQ ID NO: 40740 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaatcaactcaaatgaccat

SEQ ID NO: 40741 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
actcaaatgaccatcagtga

SEQ ID NO: 40742 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatgaccatcagtgatagac

SEQ ID NO: 40743 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catcagtgatagactggata

SEQ ID NO: 40744 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagactggataaagataatg

SEQ ID NO: 40745 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atataccatataatactatg

SEQ ID NO: 40746 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcagccattcaaaaaaaaac

SEQ ID NO: 40747 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaacgagatcatatcctttg

SEQ ID NO: 40748 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aacgagatcatatcctttgc

SEQ ID NO: 40749 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acgagatcatatcctttgca

SEQ ID NO: 40750 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atcctttgcagggacatgaa

SEQ ID NO: 40751 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cctttgcagggacatgaatg

SEQ ID NO: 40752 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgcagggacatgaatggagc

SEQ ID NO: 40753 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagggacatgaatggagctg

SEQ ID NO: 40754 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agggacatgaatggagctgg

SEQ ID NO: 40755 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagctggaggccattttcat

SEQ ID NO: 40756 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gccattttcattagtaaact

SEQ ID NO: 40757 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccattttcattagtaaacta

SEQ ID NO: 40758 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttttcattagtaaactaagg

SEQ ID NO: 40759 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttcattagtaaactaaggc

SEQ ID NO: 40760 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttagtaaactaaggcaggaa

SEQ ID NO: 40761 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taccacatgttctcacttat

SEQ ID NO: 40762 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cacatgttctcacttataag

SEQ ID NO: 40763 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acatgttctcacttataagt

SEQ ID NO: 40764 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgttctcacttataagtgg

SEQ ID NO: 40765 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ataagtgggagctaaatgat

SEQ ID NO: 40766 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agctaaatgatgagaacaca

SEQ ID NO: 40767 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgagaacacatggacacata

SEQ ID NO: 40768 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagaacacatggacacataa

SEQ ID NO: 40769 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agaacacatggacacataaa

SEQ ID NO: 40770 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taaagggtaacaacacacac

SEQ ID NO: 40771 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaagggtaacaacacacact

SEQ ID NO: 40772 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aagggtaacaacacacactg

SEQ ID NO: 40773 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaacacacactggggccta

SEQ ID NO: 40774 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caacacacactggggcctat

SEQ ID NO: 40775 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acacacactggggcctatgg

SEQ ID NO: 40776 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cacacactggggcctatggg

SEQ ID NO: 40777 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acacactggggcctatggga

SEQ ID NO: 40778 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctggggcctatgggagggtg

SEQ ID NO: 40779 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggggcctatgggagggtga

SEQ ID NO: 40780 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggggcctatgggagggtgaa

SEQ ID NO: 40781 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcctatgggagggtgaaggg

SEQ ID NO: 40782 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctatgggagggtgaagggt

SEQ ID NO: 40783 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatgggagggtgaagggtgg

SEQ ID NO: 40784 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgggagggtgaagggtggg

SEQ ID NO: 40785 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggagggtgaagggtgggagg

SEQ ID NO: 40786 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagggtgaagggtgggagga

SEQ ID NO: 40787 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gggtgaagggtgggaggaag

SEQ ID NO: 40788 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtgaagggtgggaggaagga

SEQ ID NO: 40789 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgaagggtgggaggaaggag

SEQ ID NO: 40790 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaagggtgggaggaaggaga

SEQ ID NO: 40791 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggtgggaggaaggagagggt

SEQ ID NO: 40792 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtgggaggaaggagagggtc

SEQ ID NO: 40793 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaaaaataaccaatgcatac

SEQ ID NO: 40794 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaaataaccaatgcatact

SEQ ID NO: 40795 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcatactgggattaatacct

SEQ ID NO: 40796 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catactgggattaatacctc

SEQ ID NO: 40797 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atactgggattaatacctca

SEQ ID NO: 40798 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gacatgtttacctatgtaac

SEQ ID NO: 40799 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacccctgaacttaaaataa

SEQ ID NO: 40800 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acttaaaataaaagtcaaaa

SEQ ID NO: 40801 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagtcaaaaaagtcacacaa

SEQ ID NO: 40802 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtcaaaaaagtcacacaat

SEQ ID NO: 40803 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtatatttcaaaattgctaa

SEQ ID NO: 40804 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttcaaaattgctaaaagaa

SEQ ID NO: 40805 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcttaccacaaaaaaatgat

SEQ ID NO: 40806 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taccacaaaaaaatgataag

SEQ ID NO: 40807 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
accacaaaaaaatgataagt

SEQ ID NO: 40808 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaaaatgataagtgggtg

SEQ ID NO: 40809 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgataagtgggtgaagtga

SEQ ID NO: 40810 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaagtgatggttatgttaat

SEQ ID NO: 40811 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatttctacaatgtttatg

SEQ ID NO: 40812 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgttttgtaccccataaat

SEQ ID NO: 40813 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaatgaacaaatatttaaa

SEQ ID NO: 40814 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaacagaaaaaaacatacta

SEQ ID NO: 40815 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaaaacatactacagaac

SEQ ID NO: 40816 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aacaagatccctgatgaaca

SEQ ID NO: 40817 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaataacttcatcaaaatat

SEQ ID NO: 40818 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tattagcaaactgaatgcaa

SEQ ID NO: 40819 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgatcatgtactacgacc

SEQ ID NO: 40820 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gatcatgtactacgaccaag

SEQ ID NO: 40821 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atcatgtactacgaccaagt

SEQ ID NO: 40822 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
catgtactacgaccaagtgg

SEQ ID NO: 40823 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaccaagtgggagttgtccc

SEQ ID NO: 40824 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
accaagtgggagttgtccct

SEQ ID NO: 40825 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gggagttgtccctaggatgc

SEQ ID NO: 40826 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggagttgtccctaggatgca

SEQ ID NO: 40827 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgtccctaggatgcaagga

SEQ ID NO: 40828 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caaggatggttcaacatatg

SEQ ID NO: 40829 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtgatacaccacatgatct

SEQ ID NO: 40830 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatacaccacatgatctgag

SEQ ID NO: 40831 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atacaccacatgatctgaga

SEQ ID NO: 40832 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gataaaaatcacatgatcat

SEQ ID NO: 40833 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaatcacatgatcatcag

SEQ ID NO: 40834 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaatcacatgatcatcagaa

SEQ ID NO: 40835 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catgatcatcagaagagatt

SEQ ID NO: 40836 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatcatcagaagagattcag

SEQ ID NO: 40837 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catcagaagagattcagaag

SEQ ID NO: 40838 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caaatttcaacaacctttca

SEQ ID NO: 40839 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcatggtaaaaactaaaaa

SEQ ID NO: 40840 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaactaaaaaaagaaaacaa

SEQ ID NO: 40841 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaaaaaagaaaacaaaagc

SEQ ID NO: 40842 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaaaaagaaaacaaaagct

SEQ ID NO: 40843 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagaaaacaaaagctaggta

SEQ ID NO: 40844 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaacaaaagctaggtatag

SEQ ID NO: 40845 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atagaagttgctataacttg

SEQ ID NO: 40846 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tagaagttgctataacttga

SEQ ID NO: 40847 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgaaggtttgtcccctcca

SEQ ID NO: 40848 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caatttaattgcaattgtga

SEQ ID NO: 40849 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aattgcaattgtgacagaat

SEQ ID NO: 40850 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
attgcaattgtgacagaatt

SEQ ID NO: 40851 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgcaattgtgacagaattgg

SEQ ID NO: 40852 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcaattgtgacagaattggg

SEQ ID NO: 40853 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgtgacagaattgggaggt

SEQ ID NO: 40854 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattgggaggtgagaccttt

SEQ ID NO: 40855 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgggaggtgagacctttaa

SEQ ID NO: 40856 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgggaggtgagacctttaag

SEQ ID NO: 40857 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagacctttaagaggtgttt

SEQ ID NO: 40858 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttaagaggtgtttaagttat

SEQ ID NO: 40859 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgcattaatgctgttatct

SEQ ID NO: 40860 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgcattaatgctgttatctc

SEQ ID NO: 40861 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatgctgttatctcaggatt

SEQ ID NO: 40862 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aggattgagttcattataaa

SEQ ID NO: 40863 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggattgagttcattataaac

SEQ ID NO: 40864 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgagttcattataaacagg

SEQ ID NO: 40865 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgagttcattataaacaggc

SEQ ID NO: 40866 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatcataacatgatacctta

SEQ ID NO: 40867 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catgttatgacacaacaaat

SEQ ID NO: 40868 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cacaacaaataagacctcac

SEQ ID NO: 40869 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acaaataagacctcaccaga

SEQ ID NO: 40870 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gacctcaccagacagcccct

SEQ ID NO: 40871 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtcatgaactttccatcctc

SEQ ID NO: 40872 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctccagtactgtgatcccat

SEQ ID NO: 40873 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tccagtactgtgatcccata

SEQ ID NO: 40874 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatgttcattataaattacc

SEQ ID NO: 40875 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attataaattacccagtctg

SEQ ID NO: 40876 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagtctgtggtattctgtta

SEQ ID NO: 40877 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctgtggtattctgttatag

SEQ ID NO: 40878 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttctgttatagtagcacaaa

SEQ ID NO: 40879 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttatagtagcacaaatggat

SEQ ID NO: 40880 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtagcacaaatggatgagaa

SEQ ID NO: 40881 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agcacaaatggatgagaaca

SEQ ID NO: 40882 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcacaaatggatgagaacag

SEQ ID NO: 40883 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatatacttcatgataaca

SEQ ID NO: 40884 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagactacttgaaaatccca

SEQ ID NO: 40885 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acagctaacatcgtattcaa

SEQ ID NO: 40886 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaactgaaaaactttcctgt

SEQ ID NO: 40887 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaaaaactttcctgtaagat

SEQ ID NO: 40888 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaaactttcctgtaagatc

SEQ ID NO: 40889 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttcctgtaagatcaggaat

SEQ ID NO: 40890 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gatcaggaataagacaaata

SEQ ID NO: 40891 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttgccacttgtatttaaca

SEQ ID NO: 40892 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acttgtatttaacacagcac

SEQ ID NO: 40893 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtatttaacacagcactag

SEQ ID NO: 40894 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taacacagcactagaagtcc

SEQ ID NO: 40895 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acagcactagaagtcctagc

SEQ ID NO: 40896 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agcactagaagtcctagcca

SEQ ID NO: 40897 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaagtcctagccagagaaat

SEQ ID NO: 40898 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagtcctagccagagaaatt

SEQ ID NO: 40899 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cctagccagagaaattaggc

SEQ ID NO: 40900 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaaattaggcaagaaaaac

SEQ ID NO: 40901 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taggcaagaaaaacaagtaa

SEQ ID NO: 40902 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaagacatcccaatctga

SEQ ID NO: 40903 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catcccaatctgaaagaaaa

SEQ ID NO: 40904 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgaaagaaaaaagtgttta

SEQ ID NO: 40905 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acagatgacattattttata

SEQ ID NO: 40906 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agatgacattattttatatg

SEQ ID NO: 40907 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgacattattttatatgga

SEQ ID NO: 40908 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttatatggagagtacccta

SEQ ID NO: 40909 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
accctaaagactccacacat

SEQ ID NO: 40910 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccctaaagactccacacatc

SEQ ID NO: 40911 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cacacatcaggaaaatctgt

SEQ ID NO: 40912 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaactaataaacaaatttac

SEQ ID NO: 40913 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacaaatttactagatgttg

SEQ ID NO: 40914 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acaaatttactagatgttga

SEQ ID NO: 40915 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cactaacaataaacaatctg

SEQ ID NO: 40916 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctaacaataaacaatctgaa

SEQ ID NO: 40917 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaacaatctgaagagaaaat

SEQ ID NO: 40918 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aacaatctgaagagaaaatt

SEQ ID NO: 40919 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atctgaagagaaaattagga

SEQ ID NO: 40920 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cccatttatgataacatcaa

SEQ ID NO: 40921 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atcaaaagaaataaaatact

SEQ ID NO: 40922 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcaaaagaaataaaatactt

SEQ ID NO: 40923 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacttaggatatgcttaacc

SEQ ID NO: 40924 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acttaggatatgcttaacca

SEQ ID NO: 40925 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaactacaaaatgttcatg

SEQ ID NO: 40926 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaactacaaaatgttcatga

SEQ ID NO: 40927 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgttcatgaaggaaatta

SEQ ID NO: 40928 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttcatgaaggaaattaaag

SEQ ID NO: 40929 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttaaagaagacacaaataaa

SEQ ID NO: 40930 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaagacacaaataaatgga

SEQ ID NO: 40931 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cacaaataaatggaaagacc

SEQ ID NO: 40932 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaatgcccatactaccct

SEQ ID NO: 40933 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtgatctgtgaattcaata

SEQ ID NO: 40934 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtacatatcaaaatcccaa

SEQ ID NO: 40935 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attatttactaaaataaaaa

SEQ ID NO: 40936 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaagatcctaaaattcata

SEQ ID NO: 40937 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaattcatatggaaccacaa

SEQ ID NO: 40938 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaaccacaaaagactctgaa

SEQ ID NO: 40939 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaaagactctgaatagcca

SEQ ID NO: 40940 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaatagccaaagcaatctt

SEQ ID NO: 40941 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccaaagcaatcttaagaaaa

SEQ ID NO: 40942 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cttaagaaaaaagaacaaaa

SEQ ID NO: 40943 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagaaaaaagaacaaaatgg

SEQ ID NO: 40944 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttcttatttatttatttatt

SEQ ID NO: 40945 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cttatttatttatttattga

SEQ ID NO: 40946 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatttatttatttattgaga

SEQ ID NO: 40947 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatttatttattgagagag

SEQ ID NO: 40948 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaagatctcaccctgttgcc

SEQ ID NO: 40949 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagatctcaccctgttgccc

SEQ ID NO: 40950 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctcaccctgttgcccaggc

SEQ ID NO: 40951 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcaccctgttgcccaggcca

SEQ ID NO: 40952 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgttgcccaggccagagtg

SEQ ID NO: 40953 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgcccaggccagagtgcag

SEQ ID NO: 40954 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agagtgcagtggcatgatca

SEQ ID NO: 40955 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggcatgatcatagctcactg

SEQ ID NO: 40956 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcactgcagcctcatactct

SEQ ID NO: 40957 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cactgcagcctcatactctt

SEQ ID NO: 40958 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agcctcatactcttgggctt

SEQ ID NO: 40959 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttcagtgatcctcccacct

SEQ ID NO: 40960 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttcagtgatcctcccacctc

SEQ ID NO: 40961 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcctcccacctcaggctcct

SEQ ID NO: 40962 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcccacctcaggctcctaag

SEQ ID NO: 40963 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acctcaggctcctaagtagc

SEQ ID NO: 40964 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cctcaggctcctaagtagct

SEQ ID NO: 40965 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctcctaagtagctaggacta

SEQ ID NO: 40966 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcctaagtagctaggactat

SEQ ID NO: 40967 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taggtgtgtgccatcatgct

SEQ ID NO: 40968 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acttttcaaatatcttcgta

SEQ ID NO: 40969 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttcaaatatcttcgtaaag

SEQ ID NO: 40970 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttcaaatatcttcgtaaaga

SEQ ID NO: 40971 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caaatatcttcgtaaagaag

SEQ ID NO: 40972 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagaaggagtctatcttgcc

SEQ ID NO: 40973 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agaaggagtctatcttgccc

SEQ ID NO: 40974 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggagtctatcttgcccaggc

SEQ ID NO: 40975 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccaggctggtctcaaactct

SEQ ID NO: 40976 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggtctcaaactcttggccac

SEQ ID NO: 40977 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttggccacaagtgatcctc

SEQ ID NO: 40978 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cacaagtgatcctccagcct

SEQ ID NO: 40979 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcctccagccttagcctccc

SEQ ID NO: 40980 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gccttagcctcccgagttgc

SEQ ID NO: 40981 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccttagcctcccgagttgct

SEQ ID NO: 40982 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcccgagttgctgggattat

SEQ ID NO: 40983 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gttgctgggattataagcat

SEQ ID NO: 40984 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taagcatgagccattgcacc

SEQ ID NO: 40985 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gccattgcacccagtcccca

SEQ ID NO: 40986 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccattgcacccagtccccac

SEQ ID NO: 40987 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcatttcaaaatgtataaca

SEQ ID NO: 40988 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caaagctacaacaattaaaa

SEQ ID NO: 40989 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctacaacaattaaaatagta

SEQ ID NO: 40990 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caattaaaatagtatggtcc

SEQ ID NO: 40991 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cctggcataaaacaaatata

SEQ ID NO: 40992 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctggcataaaacaaatatat

SEQ ID NO: 40993 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaatatataggccaatgaaa

SEQ ID NO: 40994 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatatataggccaatgaaac

SEQ ID NO: 40995 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tataggccaatgaaacagga

SEQ ID NO: 40996 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taggccaatgaaacaggata

SEQ ID NO: 40997 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggccaatgaaacaggataga

SEQ ID NO: 40998 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgaaacaggatagagagcc

SEQ ID NO: 40999 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaaataaacccatgcataaa

SEQ ID NO: 41000 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatagttaactcatattcaa

SEQ ID NO: 41001 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atagttaactcatattcaac

SEQ ID NO: 41002 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tagttaactcatattcaaca

SEQ ID NO: 41003 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agttaactcatattcaacag

SEQ ID NO: 41004 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcatattcaacaggggtgcc

SEQ ID NO: 41005 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggggtgccaagaatacacaa

SEQ ID NO: 41006 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gccaagaatacacaatagaa

SEQ ID NO: 41007 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caagaatacacaatagaaaa

SEQ ID NO: 41008 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagaatacacaatagaaaag

SEQ ID NO: 41009 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggccactcaacaaataatgt

SEQ ID NO: 41010 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gccactcaacaaataatgtt

SEQ ID NO: 41011 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaaataatgttgggaaaac

SEQ ID NO: 41012 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acacaaaaataaactcaaaa

SEQ ID NO: 41013 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagattaaacatttaaacct

SEQ ID NO: 41014 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cctgaaaactgtaaaacttg

SEQ ID NO: 41015 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaaactgtaaaacttgtag

SEQ ID NO: 41016 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaacttgtagaagaaaaca

SEQ ID NO: 41017 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acttgtagaagaaaacatag

SEQ ID NO: 41018 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttgtagaagaaaacatagc

SEQ ID NO: 41019 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagaagaaaacatagcagga

SEQ ID NO: 41020 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgttcttgacaatgatttct

SEQ ID NO: 41021 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgactccaaaattcaaac

SEQ ID NO: 41022 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgactccaaaattcaaacaa

SEQ ID NO: 41023 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aattcaaacaagagcaaaaa

SEQ ID NO: 41024 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagagcaaaaatagacaatt

SEQ ID NO: 41025 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgagaccatatcaaactaaa

SEQ ID NO: 41026 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catatcaaactaaaaagctt

SEQ ID NO: 41027 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atatcaaactaaaaagcttt

SEQ ID NO: 41028 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctaaaaagctttgggaaaaa

SEQ ID NO: 41029 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taaaaagctttgggaaaaaa

SEQ ID NO: 41030 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagctttgggaaaaaaagg

SEQ ID NO: 41031 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gggaaaaaaaggaagcattc

SEQ ID NO: 41032 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaaaaaaaggaagcattcaa

SEQ ID NO: 41033 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaaaaaggaagcattcaag

SEQ ID NO: 41034 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaaaaggaagcattcaaga

SEQ ID NO: 41035 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagcattcaagagggtgaaa

SEQ ID NO: 41036 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagggtgaaaaagcaaccta

SEQ ID NO: 41037 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgaaaaagcaacctatagaa

SEQ ID NO: 41038 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaaaaagcaacctatagaat

SEQ ID NO: 41039 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaagcaacctatagaatgg

SEQ ID NO: 41040 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccaactatatatctaataaa

SEQ ID NO: 41041 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tggttaatatccaaaatata

SEQ ID NO: 41042 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggttaatatccaaaatatat

SEQ ID NO: 41043 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gttaatatccaaaatatata

SEQ ID NO: 41044 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atagggaactcctgcaactt

SEQ ID NO: 41045 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gggaactcctgcaacttaag

SEQ ID NO: 41046 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggaactcctgcaacttaaga

SEQ ID NO: 41047 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgaccaacatgtatattaa

SEQ ID NO: 41048 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catgtatattaaaagatgct

SEQ ID NO: 41049 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgctcagtatcactaatcat

SEQ ID NO: 41050 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attcaaataaaaactgtaat

SEQ ID NO: 41051 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttcaaataaaaactgtaatg

SEQ ID NO: 41052 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcaaataaaaactgtaatga

SEQ ID NO: 41053 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ataaaaactgtaatgagggc

SEQ ID NO: 41054 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taaaaactgtaatgagggcc

SEQ ID NO: 41055 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actgtaatgagggccaggtg

SEQ ID NO: 41056 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtaatgagggccaggtgcag

SEQ ID NO: 41057 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtggctcatgcctgttatcc

SEQ ID NO: 41058 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgcctgttatcccagcactt

SEQ ID NO: 41059 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcctgttatcccagcacttt

SEQ ID NO: 41060 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgttatcccagcactttgg

SEQ ID NO: 41061 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgttatcccagcactttggg

SEQ ID NO: 41062 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcccagcactttgggaggcc

SEQ ID NO: 41063 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccagcactttgggaggcca

SEQ ID NO: 41064 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agcactttgggaggccaagg

SEQ ID NO: 41065 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcactttgggaggccaaggt

SEQ ID NO: 41066 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctttgggaggccaaggtggg

SEQ ID NO: 41067 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggccaaggtgggtggatcat

SEQ ID NO: 41068 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gccaaggtgggtggatcatg

SEQ ID NO: 41069 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aggtgggtggatcatgaggt

SEQ ID NO: 41070 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggtgggtggatcatgaggtc

SEQ ID NO: 41071 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgggtggatcatgaggtcag

SEQ ID NO: 41072 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatcatgaggtcaggagatc

SEQ ID NO: 41073 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcaggagatcaagaccatcc

SEQ ID NO: 41074 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caagaccatcctggccaaaa

SEQ ID NO: 41075 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctactgaaaatacaaaaat

SEQ ID NO: 41076 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctgaaaatacaaaaattagc

SEQ ID NO: 41077 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgaaaatacaaaaattagct

SEQ ID NO: 41078 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atacaaaaattagctgggca

SEQ ID NO: 41079 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caaaaattagctgggcatgg

SEQ ID NO: 41080 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtggcacatgcctgtaatcc

SEQ ID NO: 41081 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgcctgtaatcccagctact

SEQ ID NO: 41082 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcctgtaatcccagctactt

SEQ ID NO: 41083 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtaatcccagctacttggg

SEQ ID NO: 41084 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcccagctacttgggaagct

SEQ ID NO: 41085 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccagctacttgggaagctg

SEQ ID NO: 41086 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agctacttgggaagctgagg

SEQ ID NO: 41087 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gctacttgggaagctgaggc

SEQ ID NO: 41088 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tacttgggaagctgaggcag

SEQ ID NO: 41089 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggcaggagaatcacttgaac

SEQ ID NO: 41090 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcaggagaatcacttgaacc

SEQ ID NO: 41091 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caggagaatcacttgaacca

SEQ ID NO: 41092 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggagaatcacttgaaccagg

SEQ ID NO: 41093 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aatcacttgaaccagggagt

SEQ ID NO: 41094 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcacttgaaccagggagtcg

SEQ ID NO: 41095 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cacttgaaccagggagtcgg

SEQ ID NO: 41096 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaccagggagtcggaggttg

SEQ ID NO: 41097 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agggagtcggaggttgcagt

SEQ ID NO: 41098 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtcggaggttgcagtgagct

SEQ ID NO: 41099 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagatcgcgccactgcactc

SEQ ID NO: 41100 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgcgccactgcactccagcc

SEQ ID NO: 41101 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actgcactccagcctggtga

SEQ ID NO: 41102 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgcactccagcctggtgaca

SEQ ID NO: 41103 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctccagcctggtgacagagt

SEQ ID NO: 41104 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcaaaaacaaacaaacaaa

SEQ ID NO: 41105 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acaaacaaacaaacagcaac

SEQ ID NO: 41106 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caaacaaacaaacagcaaca

SEQ ID NO: 41107 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
caaacaaacagcaacaaggc

SEQ ID NO: 41108 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaacaaacagcaacaaggcc

SEQ ID NO: 41109 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aacagcaacaaggccgggcg

SEQ ID NO: 41110 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agcaacaaggccgggcgtgg

SEQ ID NO: 41111 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtggctcacgcctgtaatcc

SEQ ID NO: 41112 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgcctgtaatcccagcactt

SEQ ID NO: 41113 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcctgtaatcccagcacttt

SEQ ID NO: 41114 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgtaatcccagcactttgg

SEQ ID NO: 41115 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtaatcccagcactttggg

SEQ ID NO: 41116 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcccagcactttgggaggcc

SEQ ID NO: 41117 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
agcactttgggaggccgaga

SEQ ID NO: 41118 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcactttgggaggccgagac

SEQ ID NO: 41119 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ctttgggaggccgagacggg

SEQ ID NO: 41120 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggccgagacgggcggatcac

SEQ ID NO: 41121 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gccgagacgggcggatcacg

SEQ ID NO: 41122 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agacgggcggatcacgaggt

SEQ ID NO: 41123 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gacgggcggatcacgaggtc

SEQ ID NO: 41124 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cgggcggatcacgaggtcag

SEQ ID NO: 41125 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gatcacgaggtcaggagatc

SEQ ID NO: 41126 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcaggagatcgagaccatcc

SEQ ID NO: 41127 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atcgagaccatcctggctaa

SEQ ID NO: 41128 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcgagaccatcctggctaac

SEQ ID NO: 41129 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cgagaccatcctggctaaca

SEQ ID NO: 41130 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctactaaaaatacaaaaat

SEQ ID NO: 41131 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ctaaaaatacaaaaattagc

SEQ ID NO: 41132 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taaaaatacaaaaattagcc

SEQ ID NO: 41133 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atacaaaaattagccgggca

SEQ ID NO: 41134 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caaaaattagccgggcatgg

SEQ ID NO: 41135 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggcatggtggcgcacgcctg

SEQ ID NO: 41136 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtggcgcacgcctgtagtcc

SEQ ID NO: 41137 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
cgcctgtagtcccagctaca

SEQ ID NO: 41138 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcctgtagtcccagctacac

SEQ ID NO: 41139 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgtagtcccagctacacgg

SEQ ID NO: 41140 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtagtcccagctacacggg

SEQ ID NO: 41141 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcccagctacacgggaggct

SEQ ID NO: 41142 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccagctacacgggaggctg

SEQ ID NO: 41143 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agctacacgggaggctgagg

SEQ ID NO: 41144 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gctacacgggaggctgaggc

SEQ ID NO: 41145 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tacacgggaggctgaggcag

SEQ ID NO: 41146 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gggaggctgaggcaggagaa

SEQ ID NO: 41147 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gcaggagaatggcgtgaacc

SEQ ID NO: 41148 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caggagaatggcgtgaaccc

SEQ ID NO: 41149 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggagaatggcgtgaacccgg

SEQ ID NO: 41150 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagaatggcgtgaacccggg

SEQ ID NO: 41151 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aatggcgtgaacccgggagg

SEQ ID NO: 41152 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggcgtgaacccgggaggcg

SEQ ID NO: 41153 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacccgggaggcggagcttg

SEQ ID NO: 41154 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cgggaggcggagcttgcagt

SEQ ID NO: 41155 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggcggagcttgcagtgagtc

SEQ ID NO: 41156 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagatcgcgccactgcactc

SEQ ID NO: 41157 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgcgccactgcactccagcc

SEQ ID NO: 41158 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcgccactgcactccagcct

SEQ ID NO: 41159 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgcactccagcctgggcga

SEQ ID NO: 41160 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcactccagcctgggcgaca

SEQ ID NO: 41161 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaaaaaaaaaaaaaaaaaa

SEQ ID NO: 41162 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacagcaacaaaaaaccgta

SEQ ID NO: 41163 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagcaacaaaaaaccgtaaa

SEQ ID NO: 41164 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agatatcatttcatacctgc

SEQ ID NO: 41165 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gatatcatttcatacctgct

SEQ ID NO: 41166 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcatttcatacctgctagga

SEQ ID NO: 41167 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acaaaaaccacccaaatcaa

SEQ ID NO: 41168 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccacccaaatcaaaagataa

SEQ ID NO: 41169 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cacccaaatcaaaagataat

SEQ ID NO: 41170 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatcaaaagataataggtgt

SEQ ID NO: 41171 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaagataataggtgttggc

SEQ ID NO: 41172 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaagataataggtgttggca

SEQ ID NO: 41173 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aataggtgttggcaaggata

SEQ ID NO: 41174 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taggtgttggcaaggatatg

SEQ ID NO: 41175 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tggcaaggatatggagaaat

SEQ ID NO: 41176 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttagaacctttgtacattgt

SEQ ID NO: 41177 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgttggaatgtaaaatgatg

SEQ ID NO: 41178 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtaaaatgatgtagctgcca

SEQ ID NO: 41179 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gatgtagctgccatagaaaa

SEQ ID NO: 41180 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgccatagaaaacagtatga

SEQ ID NO: 41181 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatataactaccatttgatc

SEQ ID NO: 41182 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gatctagcaatgccacatct

SEQ ID NO: 41183 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atattttaaaaatttgaact

SEQ ID NO: 41184 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tattttaaaaatttgaactc

SEQ ID NO: 41185 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaatttgaactcaggatct

SEQ ID NO: 41186 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatttgaactcaggatctca

SEQ ID NO: 41187 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccttacttccatgttcactt

SEQ ID NO: 41188 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaatgtctattgatgaatga

SEQ ID NO: 41189 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aatgtctattgatgaatgat

SEQ ID NO: 41190 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctattgatgaatgatggga

SEQ ID NO: 41191 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaatgatgggatagaaaatg

SEQ ID NO: 41192 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acacacaaacacacactatt

SEQ ID NO: 41193 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acacactattcagccttata

SEQ ID NO: 41194 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cactattcagccttataaag

SEQ ID NO: 41195 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actattcagccttataaaga

SEQ ID NO: 41196 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaaggaaatcctgccatatg

SEQ ID NO: 41197 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgcagcaacttgaatgaacc

SEQ ID NO: 41198 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aacctggataaatttatgct

SEQ ID NO: 41199 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggataaatttatgctgagtg

SEQ ID NO: 41200 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atttatgctgagtgaagtaa

SEQ ID NO: 41201 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aatattgcataattccactt

SEQ ID NO: 41202 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcataattccacttcggtg

SEQ ID NO: 41203 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cttcggtgaagtaactaaaa

SEQ ID NO: 41204 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aactaaaatggtcaaactca

SEQ ID NO: 41205 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatggtcaaactcatggaaa

SEQ ID NO: 41206 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggtcaaactcatggaaaca

SEQ ID NO: 41207 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtcaaactcatggaaacaga

SEQ ID NO: 41208 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaactcatggaaacagagag

SEQ ID NO: 41209 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catggaaacagagagaagaa

SEQ ID NO: 41210 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagagaagaatggtgattgc

SEQ ID NO: 41211 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agagaagaatggtgattgcc

SEQ ID NO: 41212 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gagaagaatggtgattgcca

SEQ ID NO: 41213 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggtgattgccagggcatga

SEQ ID NO: 41214 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggtgattgccagggcatgaa

SEQ ID NO: 41215 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attgccagggcatgaaagga

SEQ ID NO: 41216 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttgccagggcatgaaaggat

SEQ ID NO: 41217 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gccagggcatgaaaggatgg

SEQ ID NO: 41218 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggcatgaaaggatgggagaa

SEQ ID NO: 41219 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
catgaaaggatgggagaatg

SEQ ID NO: 41220 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatggagaattgctattcaa

SEQ ID NO: 41221 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atggagaattgctattcaat

SEQ ID NO: 41222 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attgctattcaatgggaata

SEQ ID NO: 41223 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaataaagtttcaattatgc

SEQ ID NO: 41224 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcaattatgcaagatgaat

SEQ ID NO: 41225 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatgcaagatgaataagttc

SEQ ID NO: 41226 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgcaagatgaataagttct

SEQ ID NO: 41227 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgcaagatgaataagttcta

SEQ ID NO: 41228 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taagttctagggacttcctg

SEQ ID NO: 41229 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cctgtagtacttcgtaacta

SEQ ID NO: 41230 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
actatagttaacaatatata

SEQ ID NO: 41231 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtatacttaaaaattttgtt

SEQ ID NO: 41232 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tacttaaaaattttgttaag

SEQ ID NO: 41233 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acttaaaaattttgttaagc

SEQ ID NO: 41234 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaaaattttgttaagcagg

SEQ ID NO: 41235 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagcaggtagatctcatatt

SEQ ID NO: 41236 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttaccacaataattaaaat

SEQ ID NO: 41237 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttaccacaataattaaaatt

SEQ ID NO: 41238 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cacaataattaaaattagga

SEQ ID NO: 41239 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acaataattaaaattaggaa

SEQ ID NO: 41240 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattaaaattaggaaaggca

SEQ ID NO: 41241 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaattaggaaaggcaaagaa

SEQ ID NO: 41242 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aattaggaaaggcaaagaaa

SEQ ID NO: 41243 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttcatttgttttttttctt

SEQ ID NO: 41244 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttttttctttggaataaat

SEQ ID NO: 41245 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaataaatgagttcatcaca

SEQ ID NO: 41246 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atctactacgtacttctaca

SEQ ID NO: 41247 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagcatgtgttaactaattg

SEQ ID NO: 41248 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtgttaactaattgaagtgt

SEQ ID NO: 41249 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagtgttggtcatgtttttt

SEQ ID NO: 41250 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtgttggtcatgttttttc

SEQ ID NO: 41251 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtgttggtcatgttttttca

SEQ ID NO: 41252 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttggtcatgttttttcaggg

SEQ ID NO: 41253 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggtcatgttttttcagggaa

SEQ ID NO: 41254 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catgttttttcagggaagag

SEQ ID NO: 41255 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttttcagggaagagtgga

SEQ ID NO: 41256 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaaagaaattctaaatcatt

SEQ ID NO: 41257 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaattctaaatcattcagaa

SEQ ID NO: 41258 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aattctaaatcattcagaaa

SEQ ID NO: 41259 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctaaatcattcagaaaaggt

SEQ ID NO: 41260 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagaaaaggtcagaaaataa

SEQ ID NO: 41261 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagaaaataaaagctatact

SEQ ID NO: 41262 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaagctatacttagattgc

SEQ ID NO: 41263 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagattgcaagatgaaatac

SEQ ID NO: 41264 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attgcaagatgaaatactgg

SEQ ID NO: 41265 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgaaatactggaagaatga

SEQ ID NO: 41266 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgaaatactggaagaatgat

SEQ ID NO: 41267 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaaatactggaagaatgata

SEQ ID NO: 41268 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaatactggaagaatgatag

SEQ ID NO: 41269 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggaagaatgataggggatat

SEQ ID NO: 41270 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtttttgatgcttctaaat

SEQ ID NO: 41271 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cagtaactgtttcctgactt

SEQ ID NO: 41272 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taactgtttcctgactttgg

SEQ ID NO: 41273 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttcctgactttggtggtga

SEQ ID NO: 41274 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccatcctattttacttcctg

SEQ ID NO: 41275 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcctattttacttcctgcag

SEQ ID NO: 41276 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcctgcagtagaaatgttgt

SEQ ID NO: 41277 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttgtaagaataacattaac

SEQ ID NO: 41278 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtaagaataacattaacaag

SEQ ID NO: 41279 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taagaataacattaacaagc

SEQ ID NO: 41280 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaataacattaacaagcagg

SEQ ID NO: 41281 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attaacaagcaggaagatta

SEQ ID NO: 41282 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcaggaagattaaagtcaat

SEQ ID NO: 41283 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gattaaagtcaattggatgt

SEQ ID NO: 41284 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatgctcatactgctctttc

SEQ ID NO: 41285 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cacgcttaatttatcctatg

SEQ ID NO: 41286 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acgcttaatttatcctatgc

SEQ ID NO: 41287 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cgcttaatttatcctatgca

SEQ ID NO: 41288 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaatttatcctatgcaggg

SEQ ID NO: 41289 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatcctatgcagggaagact

SEQ ID NO: 41290 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atcctatgcagggaagactg

SEQ ID NO: 41291 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtatgtatatataatgctt

SEQ ID NO: 41292 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtatatataatgcttaagtt

SEQ ID NO: 41293 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagaaaaataaattgaaaat

SEQ ID NO: 41294 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tacactttataaatgtaaaa

SEQ ID NO: 41295 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acatctgtatttgtaaatgt

SEQ ID NO: 41296 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catctgtatttgtaaatgtc

SEQ ID NO: 41297 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatttttgtctacttgcaaa

SEQ ID NO: 41298 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catgcacactaatgacattt

SEQ ID NO: 41299 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacatgtacatctgtcttct

SEQ ID NO: 41300 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catctgtcttcttagatgct

SEQ ID NO: 41301 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtcttcttagatgctaagc

SEQ ID NO: 41302 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcttttgtaattctaccatt

SEQ ID NO: 41303 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attctaccatttagtctcca

SEQ ID NO: 41304 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tccaaagatctctttttgta

SEQ ID NO: 41305 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccaaagatctctttttgtat

SEQ ID NO: 41306 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagatctctttttgtatagg

SEQ ID NO: 41307 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtataggtggtaccacaac

SEQ ID NO: 41308 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tataggtggtaccacaacca

SEQ ID NO: 41309 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtaccacaaccagagtatct

SEQ ID NO: 41310 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cacaaccagagtatctcagt

SEQ ID NO: 41311 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagtatctcagttagttgac

SEQ ID NO: 41312 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agttagttgacaagaaactc

SEQ ID NO: 41313 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgacaagaaactccagaat

SEQ ID NO: 41314 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctttatctcttgcaaatcac

SEQ ID NO: 41315 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcaaatcacaagcaatactg

SEQ ID NO: 41316 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taccctctaaaatgttttaa

SEQ ID NO: 41317 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcctattctccattgacaca

SEQ ID NO: 41318 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cctattctccattgacacac

SEQ ID NO: 41319 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attgacacacaggactaatt

SEQ ID NO: 41320 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgacacacaggactaatttg

SEQ ID NO: 41321 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acaggactaatttggagact

SEQ ID NO: 41322 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
actaatttggagacttagtg

SEQ ID NO: 41323 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttggagacttagtgtggtc

SEQ ID NO: 41324 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttggagacttagtgtggtcc

SEQ ID NO: 41325 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gagacttagtgtggtccagg

SEQ ID NO: 41326 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acttagtgtggtccaggtgg

SEQ ID NO: 41327 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttagtgtggtccaggtggc

SEQ ID NO: 41328 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtggtccaggtggcaggtc

SEQ ID NO: 41329 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggtccaggtggcaggtcaag

SEQ ID NO: 41330 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtccaggtggcaggtcaagc

SEQ ID NO: 41331 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tccaggtggcaggtcaagca

SEQ ID NO: 41332 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aggtcaagcagggtctgaaa

SEQ ID NO: 41333 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcagggtctgaaatagtctt

SEQ ID NO: 41334 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatagtctttggtccttccc

SEQ ID NO: 41335 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtcattttgtgcatcactgc

SEQ ID NO: 41336 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgctagattaattttttgta

SEQ ID NO: 41337 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gattaattttttgtaaagct

SEQ ID NO: 41338 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttttgtaaagctcagtctc

SEQ ID NO: 41339 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaagctcagtctctagaaa

SEQ ID NO: 41340 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtctctagaaaaagcaattc

SEQ ID NO: 41341 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctctagaaaaagcaattctg

SEQ ID NO: 41342 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agaaaaagcaattctggagc

SEQ ID NO: 41343 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tccataatgaaactactttt

SEQ ID NO: 41344 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgaaactactttttagctgt

SEQ ID NO: 41345 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaactactttttagctgtc

SEQ ID NO: 41346 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgtcaggccatgtgcaaat

SEQ ID NO: 41347 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcaaataagataatttttct

SEQ ID NO: 41348 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaataagataatttttctga

SEQ ID NO: 41349 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aataagataatttttctgag

SEQ ID NO: 41350 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atttttctgagaggttaaat

SEQ ID NO: 41351 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttttctgagaggttaaatg

SEQ ID NO: 41352 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatgaggatactatgtcttt

SEQ ID NO: 41353 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatttgactacaattatgt

SEQ ID NO: 41354 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttgactacaattatgttag

SEQ ID NO: 41355 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatgttagaagtattttaca

SEQ ID NO: 41356 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgttagaagtattttacac

SEQ ID NO: 41357 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acacaggatctgacatatca

SEQ ID NO: 41358 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acaggatctgacatatcatg

SEQ ID NO: 41359 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacatatatgaatgaaacac

SEQ ID NO: 41360 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacaccagctgctattaaaa

SEQ ID NO: 41361 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acaccagctgctattaaaaa

SEQ ID NO: 41362 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ctattaaaaaaggtctaata

SEQ ID NO: 41363 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cggctttttatatctactct

SEQ ID NO: 41364 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggctttttatatctactctc

SEQ ID NO: 41365 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttttatatctactctcagg

SEQ ID NO: 41366 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttttatatctactctcaggc

SEQ ID NO: 41367 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaaatttcttcaaaaccga

SEQ ID NO: 41368 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catttctgtttcactccatg

SEQ ID NO: 41369 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atttctgtttcactccatgt

SEQ ID NO: 41370 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgtttcactccatgtgggt

SEQ ID NO: 41371 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtcttctttcccaccttcca

SEQ ID NO: 41372 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtatttcataaaccattcta

SEQ ID NO: 41373 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttcataaaccattctatag

SEQ ID NO: 41374 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tattgtatttatcatgatta

SEQ ID NO: 41375 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttatcatgattatagtatt

SEQ ID NO: 41376 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttatcatgattatagtattt

SEQ ID NO: 41377 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tatcatgattatagtatttg

SEQ ID NO: 41378 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgattatagtatttgggga

SEQ ID NO: 41379 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gattatagtatttggggata

SEQ ID NO: 41380 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tagtatttggggatagagca

SEQ ID NO: 41381 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatttggggatagagcatag

SEQ ID NO: 41382 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttggggatagagcatagta

SEQ ID NO: 41383 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggggatagagcatagtaga

SEQ ID NO: 41384 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagcatagtagagagtttaa

SEQ ID NO: 41385 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcatagtagagagtttaata

SEQ ID NO: 41386 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagagagtttaatagagtac

SEQ ID NO: 41387 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acatactcgatatatgacct

SEQ ID NO: 41388 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
catactcgatatatgacctt

SEQ ID NO: 41389 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctcgatatatgaccttgggt

SEQ ID NO: 41390 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgcctttcctcatttgtga

SEQ ID NO: 41391 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcctttcctcatttgtgaaa

SEQ ID NO: 41392 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tacttttgtgattgatgtta

SEQ ID NO: 41393 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acttttgtgattgatgttat

SEQ ID NO: 41394 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgtgattgatgttatgggt

SEQ ID NO: 41395 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgggttggattgtgtgccct

SEQ ID NO: 41396 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttggattgtgtgccctaag

SEQ ID NO: 41397 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttggattgtgtgccctaaga

SEQ ID NO: 41398 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgccctaagaaggtacatat

SEQ ID NO: 41399 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacatataagtcctaaccct

SEQ ID NO: 41400 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtcctaacccttagcactt

SEQ ID NO: 41401 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atttgaaaataatgtcattg

SEQ ID NO: 41402 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgtcattgcagatgtaatt

SEQ ID NO: 41403 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgcagatgtaattaagatg

SEQ ID NO: 41404 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taattaagatgaagtcatac

SEQ ID NO: 41405 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attaagatgaagtcatactg

SEQ ID NO: 41406 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagatgaagtcatactggag

SEQ ID NO: 41407 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gatgaagtcatactggagtg

SEQ ID NO: 41408 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaagtcatactggagtggag

SEQ ID NO: 41409 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aagtcatactggagtggagt

SEQ ID NO: 41410 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtggagtgggctcttaatc

SEQ ID NO: 41411 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggctcttaatccagtgtgac

SEQ ID NO: 41412 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtgtgactggcatccttac

SEQ ID NO: 41413 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtgactggcatccttactag

SEQ ID NO: 41414 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gactggcatccttactagta

SEQ ID NO: 41415 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actggcatccttactagtag

SEQ ID NO: 41416 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggcatccttactagtagag

SEQ ID NO: 41417 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atccttactagtagaggaga

SEQ ID NO: 41418 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tagtagaggagaaagacaca

SEQ ID NO: 41419 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtagaggagaaagacacaca

SEQ ID NO: 41420 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tagaggagaaagacacacag

SEQ ID NO: 41421 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agaggagaaagacacacaga

SEQ ID NO: 41422 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaagacacacagagggaaaa

SEQ ID NO: 41423 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaatggcatgtcactataa

SEQ ID NO: 41424 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaatggcatgtcactataat

SEQ ID NO: 41425 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atggcatgtcactataatgg

SEQ ID NO: 41426 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggcatgtcactataatggga

SEQ ID NO: 41427 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtcactataatgggagagat

SEQ ID NO: 41428 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cactataatgggagagattg

SEQ ID NO: 41429 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagttctgttgccataaacc

SEQ ID NO: 41430 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gccataaaccaagaaacacc

SEQ ID NO: 41431 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccataaaccaagaaacacct

SEQ ID NO: 41432 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccaagaaacacctgggctac

SEQ ID NO: 41433 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaaacacctgggctaccag

SEQ ID NO: 41434 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acacctgggctaccagaagc

SEQ ID NO: 41435 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cctgggctaccagaagctgg

SEQ ID NO: 41436 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgggctaccagaagctggaa

SEQ ID NO: 41437 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gggctaccagaagctggaag

SEQ ID NO: 41438 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggcaataaaatatattttct

SEQ ID NO: 41439 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caataaaatatattttctta

SEQ ID NO: 41440 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aataaaatatattttcttag

SEQ ID NO: 41441 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atattttcttagaggcttta

SEQ ID NO: 41442 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attttcttagaggctttaaa

SEQ ID NO: 41443 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagaggctttaaagagaaca

SEQ ID NO: 41444 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acctgctgacactttgaatt

SEQ ID NO: 41445 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttggacttctaacctccaa

SEQ ID NO: 41446 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cttctaacctccaaaagtgt

SEQ ID NO: 41447 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctaacctccaaaagtgtga

SEQ ID NO: 41448 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaatatatttctcttgtttt

SEQ ID NO: 41449 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttctcttgttttaagccct

SEQ ID NO: 41450 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttctcttgttttaagccctc

SEQ ID NO: 41451 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttgtattatcctgttctcg

SEQ ID NO: 41452 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgtattatcctgttctcgt

SEQ ID NO: 41453 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatcctgttctcgtaggtca

SEQ ID NO: 41454 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtaggtcaaagaaactaata

SEQ ID NO: 41455 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaactaatacagttgatgtg

SEQ ID NO: 41456 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gattaattaattaaaaattt

SEQ ID NO: 41457 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taattaattaaaaatttcag

SEQ ID NO: 41458 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcagaagattgctcaaatta

SEQ ID NO: 41459 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctcaaattacagtattcaac

SEQ ID NO: 41460 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgctatgacataaactcctt

SEQ ID NO: 41461 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgacataaactccttgagct

SEQ ID NO: 41462 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gacataaactccttgagctc

SEQ ID NO: 41463 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcaggaaccatatcttacgt

SEQ ID NO: 41464 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatcttacgttggtctcccc

SEQ ID NO: 41465 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaaatgtgttttgaataaa

SEQ ID NO: 41466 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttaattattcaatcctcta

SEQ ID NO: 41467 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttaattattcaatcctctat

SEQ ID NO: 41468 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caatcctctataggaaacat

SEQ ID NO: 41469 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ataggaaacattggaaaaaa

SEQ ID NO: 41470 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaacattggaaaaaacagaa

SEQ ID NO: 41471 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gatatattgctcaaaaccta

SEQ ID NO: 41472 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atatattgctcaaaacctat

SEQ ID NO: 41473 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgggtttaacctaaatcat

SEQ ID NO: 41474 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtttaacctaaatcataagt

SEQ ID NO: 41475 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacctaaatcataagttagc

SEQ ID NO: 41476 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttagccagaacctattatt

SEQ ID NO: 41477 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttctgtgcaaaaatgaat

SEQ ID NO: 41478 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgcaaaaatgaataagatt

SEQ ID NO: 41479 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcatatttgtaattgtatac

SEQ ID NO: 41480 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattatttgaaaaataaatg

SEQ ID NO: 41481 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaactttacattatcttttt

SEQ ID NO: 41482 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tacttatcttctttttctgt

SEQ ID NO: 41483 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctatgatgacaccaatgaac

SEQ ID NO: 41484 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gacaccaatgaacaagttca

SEQ ID NO: 41485 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caatgaacaagttcaaagtg

SEQ ID NO: 41486 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcaaagtgaagaatgaccca

SEQ ID NO: 41487 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaatgacccaaagatgata

SEQ ID NO: 41488 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cgacaaaataaatatacatg

SEQ ID NO: 41489 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acaaaataaatatacatgta

SEQ ID NO: 41490 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caaaataaatatacatgtag

SEQ ID NO: 41491 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtagaggctatattcatatt

SEQ ID NO: 41492 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tagaggctatattcatattt

SEQ ID NO: 41493 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctacctataaaatttacaa

SEQ ID NO: 41494 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cctataaaatttacaaaagt

SEQ ID NO: 41495 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttacaaaagttagcattata

SEQ ID NO: 41496 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaagttagcattatatgga

SEQ ID NO: 41497 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcattattttctttttcaca

SEQ ID NO: 41498 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctttttcacatggtttgac

SEQ ID NO: 41499 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctttttcacatggtttgacc

SEQ ID NO: 41500 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtttgaccaggtaattcaaa

SEQ ID NO: 41501 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taattcaaacagtgctatcc

SEQ ID NO: 41502 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aattcaaacagtgctatcct

SEQ ID NO: 41503 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtgctatcctaggtaaaca

SEQ ID NO: 41504 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtgctatcctaggtaaacat

SEQ ID NO: 41505 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cctaggtaaacataggattt

SEQ ID NO: 41506 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggtaaacataggatttaag

SEQ ID NO: 41507 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acataggatttaagaagcca

SEQ ID NO: 41508 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taagaagccatagcattgtt

SEQ ID NO: 41509 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagaagccatagcattgttg

SEQ ID NO: 41510 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataatcttcaaataactaca

SEQ ID NO: 41511 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taatcttcaaataactacaa

SEQ ID NO: 41512 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aatcttcaaataactacaaa

SEQ ID NO: 41513 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgcatatttgtgctcatat

SEQ ID NO: 41514 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catatttgtgctcatattgg

SEQ ID NO: 41515 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atatttgtgctcatattggt

SEQ ID NO: 41516 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggtaggaaaattcaataact

SEQ ID NO: 41517 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatgtatatgttatttccaa

SEQ ID NO: 41518 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttccaaaagtactgtaaat

SEQ ID NO: 41519 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tattttgtaaaaatattacc

SEQ ID NO: 41520 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attttgtaaaaatattacct

SEQ ID NO: 41521 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttttgtaaaaatattaccta

SEQ ID NO: 41522 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgtaaaaatattacctagg

SEQ ID NO: 41523 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacctagggagtaatcatta

SEQ ID NO: 41524 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagtaatcattaaagtttct

SEQ ID NO: 41525 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atcattaaagtttcttagca

SEQ ID NO: 41526 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatttcacataaactcatcc

SEQ ID NO: 41527 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atttcacataaactcatcca

SEQ ID NO: 41528 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggtgttttaaactgtaaaaa

SEQ ID NO: 41529 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaaactgtaaaaacagtaa

SEQ ID NO: 41530 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tattttatttttattttgat

SEQ ID NO: 41531 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgataagcgcatatttact

SEQ ID NO: 41532 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcgcatatttactgagcatt

SEQ ID NO: 41533 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tactgagcatttagtaatgc

SEQ ID NO: 41534 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagtaatgccagcctgcact

SEQ ID NO: 41535 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccctgcttctattttcttgt

SEQ ID NO: 41536 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctgcttctattttcttgtt

SEQ ID NO: 41537 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gttgggtcctcacaacacta

SEQ ID NO: 41538 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgggtcctcacaacactatg

SEQ ID NO: 41539 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtcctcacaacactatggag

SEQ ID NO: 41540 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcctcacaacactatggagt

SEQ ID NO: 41541 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caacactatggagtaggcat

SEQ ID NO: 41542 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagtaggcattggatgattg

SEQ ID NO: 41543 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggatgattgtagacatttat

SEQ ID NO: 41544 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gacatttattagacaaatga

SEQ ID NO: 41545 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgatagattcattaaatta

SEQ ID NO: 41546 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agattcattaaattatagat

SEQ ID NO: 41547 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atagattagacaaataaact

SEQ ID NO: 41548 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agacaaataaactaagtctc

SEQ ID NO: 41549 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaataaactaagtctcaag

SEQ ID NO: 41550 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaataaactaagtctcaaga

SEQ ID NO: 41551 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaactaagtctcaagaaggt

SEQ ID NO: 41552 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aactaagtctcaagaaggta

SEQ ID NO: 41553 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaggtaaggtaatttgcccg

SEQ ID NO: 41554 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaggtaatttgcccgaagt

SEQ ID NO: 41555 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatttgcccgaagtcagttg

SEQ ID NO: 41556 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttgcccgaagtcagttgta

SEQ ID NO: 41557 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccgaagtcagttgtagagct

SEQ ID NO: 41558 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gttgtagagcttggatgata

SEQ ID NO: 41559 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agagcttggatgatatggta

SEQ ID NO: 41560 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttggatgatatggtacagc

SEQ ID NO: 41561 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggtacagctagaatttgaat

SEQ ID NO: 41562 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtacagctagaatttgaatc

SEQ ID NO: 41563 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
actgctgtactcacaaccac

SEQ ID NO: 41564 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctgctgtactcacaaccact

SEQ ID NO: 41565 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cacaaccactaggctactat

SEQ ID NO: 41566 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acaaccactaggctactatc

SEQ ID NO: 41567 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
accactaggctactatcagg

SEQ ID NO: 41568 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgttcttcattgtctatgt

SEQ ID NO: 41569 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcattgtctatgtgagtccc

SEQ ID NO: 41570 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cattgtctatgtgagtccca

SEQ ID NO: 41571 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
attgtctatgtgagtcccaa

SEQ ID NO: 41572 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgagtcccaagggcttcatg

SEQ ID NO: 41573 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccaagggcttcatgaagtta

SEQ ID NO: 41574 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggcttcatgaagttatagtt

SEQ ID NO: 41575 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggaaatcactgaaataaact

SEQ ID NO: 41576 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatcactgaaataaactaag

SEQ ID NO: 41577 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctaagaagcttttaaaaata

SEQ ID NO: 41578 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagcttttaaaaataaagtt

SEQ ID NO: 41579 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaaataaagtttagtgct

SEQ ID NO: 41580 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ataatcaatacttacattaa

SEQ ID NO: 41581 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aataatcgtccatcccttaa

SEQ ID NO: 41582 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atcccttaaaagttgccttt

SEQ ID NO: 41583 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcctttaagaataacattaa

SEQ ID NO: 41584 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attaatagaatttgaatgtt

SEQ ID NO: 41585 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttaagctcatattctaaaa

SEQ ID NO: 41586 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tattctaaaatagccataaa

SEQ ID NO: 41587 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttctaaaatagccataaaca

SEQ ID NO: 41588 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaatgttaccacaattatt

SEQ ID NO: 41589 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccacaattattaagtaatac

SEQ ID NO: 41590 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattattaagtaatactagt

SEQ ID NO: 41591 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caacatgtccatttaatgta

SEQ ID NO: 41592 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgtaaagatttttttaaa

SEQ ID NO: 41593 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgtaaagatttttttaaaa

SEQ ID NO: 41594 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttaaaaaggacatattccc

SEQ ID NO: 41595 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccaagtaacattctaaatct

SEQ ID NO: 41596 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacattctaaatcttagtcc

SEQ ID NO: 41597 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taattatttctaaattgtta

SEQ ID NO: 41598 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acataaccttttatttttta

SEQ ID NO: 41599 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cataaccttttattttttaa

SEQ ID NO: 41600 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccttttattttttaaaggtg

SEQ ID NO: 41601 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttttattttttaaaggtga

SEQ ID NO: 41602 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaaggaaaattttatgaat

SEQ ID NO: 41603 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggaaaattttatgaataaga

SEQ ID NO: 41604 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaaattttatgaataagac

SEQ ID NO: 41605 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catcttttctccatttttta

SEQ ID NO: 41606 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atcttttctccattttttaa

SEQ ID NO: 41607 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcttttctccattttttaaa

SEQ ID NO: 41608 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taaagggttctccatgcctg

SEQ ID NO: 41609 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaagggttctccatgcctgt

SEQ ID NO: 41610 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gggttctccatgcctgtggg

SEQ ID NO: 41611 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagttcctctcatcccttca

SEQ ID NO: 41612 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctcatcccttcatagtgtg

SEQ ID NO: 41613 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catcccttcatagtgtgaag

SEQ ID NO: 41614 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atcccttcatagtgtgaagc

SEQ ID NO: 41615 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccttcatagtgtgaagcagg

SEQ ID NO: 41616 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcaaaaacgttcatttttg

SEQ ID NO: 41617 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttttgaagcaatatttgaa

SEQ ID NO: 41618 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagcaatatttgaatggtgc

SEQ ID NO: 41619 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatatttgaatggtgcaaga

SEQ ID NO: 41620 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atatttgaatggtgcaagat

SEQ ID NO: 41621 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atttgaatggtgcaagatgg

SEQ ID NO: 41622 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgggagtccacatgacacca

SEQ ID NO: 41623 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggagtccacatgacaccaaa

SEQ ID NO: 41624 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aattaataactcaaatgcaa

SEQ ID NO: 41625 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acccatgcttcttattcatg

SEQ ID NO: 41626 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccatgcttcttattcatgt

SEQ ID NO: 41627 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attcatgtaggaacatgttc

SEQ ID NO: 41628 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttcatgtaggaacatgttct

SEQ ID NO: 41629 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtaggaacatgttctagga

SEQ ID NO: 41630 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttttttttttttttttttt

SEQ ID NO: 41631 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttttttttttttttgagac

SEQ ID NO: 41632 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttttttttttttgagacaa

SEQ ID NO: 41633 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagacaagagtctcgctctg

SEQ ID NO: 41634 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagagtctcgctctgtagcc

SEQ ID NO: 41635 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agagtctcgctctgtagccc

SEQ ID NO: 41636 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctcgctctgtagcccaggc

SEQ ID NO: 41637 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcgctctgtagcccaggctg

SEQ ID NO: 41638 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgtagcccaggctggagtg

SEQ ID NO: 41639 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagcccaggctggagtgcag

SEQ ID NO: 41640 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggagtgcagtggcacgatct

SEQ ID NO: 41641 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccactgcaacctccgcctcc

SEQ ID NO: 41642 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cactgcaacctccgcctccc

SEQ ID NO: 41643 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcacgtgattctcctgcct

SEQ ID NO: 41644 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttctcctgcctcagcctccc

SEQ ID NO: 41645 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcctgcctcagcctcccaag

SEQ ID NO: 41646 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcctcagcctcccaagcagc

SEQ ID NO: 41647 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cctcagcctcccaagcagct

SEQ ID NO: 41648 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcccaagcagctaggatta

SEQ ID NO: 41649 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcccaagcagctaggattac

SEQ ID NO: 41650 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caggcgcctgccaccacacc

SEQ ID NO: 41651 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agctaatttttttgtatttt

SEQ ID NO: 41652 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taatttttttgtatttttag

SEQ ID NO: 41653 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atttttttgtatttttagta

SEQ ID NO: 41654 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttttgtatttttagtagaga

SEQ ID NO: 41655 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttgtatttttagtagagat

SEQ ID NO: 41656 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttgtatttttagtagagatg

SEQ ID NO: 41657 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gagatggggtttcactatgt

SEQ ID NO: 41658 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tggggtttcactatgttggc

SEQ ID NO: 41659 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttcactatgttggccagac

SEQ ID NO: 41660 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acctcatgatctgcccacct

SEQ ID NO: 41661 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgcccaccttggcctccca

SEQ ID NO: 41662 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caccttggcctcccaaagtg

SEQ ID NO: 41663 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccttggcctcccaaagtgaa

SEQ ID NO: 41664 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcccaaagtgaagagacta

SEQ ID NO: 41665 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcccaaagtgaagagactac

SEQ ID NO: 41666 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtgaagagactacaggcat

SEQ ID NO: 41667 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
caggcatgagccactgcgcc

SEQ ID NO: 41668 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgagccactgcgcccggcc

SEQ ID NO: 41669 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccactgcgcccggccaagac

SEQ ID NO: 41670 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcactgttttaaaaaccaca

SEQ ID NO: 41671 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tataattaatatactattta

SEQ ID NO: 41672 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccaatatctattaaaatacc

SEQ ID NO: 41673 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aataccaagcactcatgaaa

SEQ ID NO: 41674 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ataccaagcactcatgaaat

SEQ ID NO: 41675 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgggacacttacaacttg

SEQ ID NO: 41676 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gggacacttacaacttgaag

SEQ ID NO: 41677 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gacacttacaacttgaagca

SEQ ID NO: 41678 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttacaacttgaagcagaga

SEQ ID NO: 41679 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttacaacttgaagcagagat

SEQ ID NO: 41680 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaagcagagataggtaacc

SEQ ID NO: 41681 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaccaagtccgacattatca

SEQ ID NO: 41682 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acattatcaaagttcacttt

SEQ ID NO: 41683 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cattatcaaagttcactttc

SEQ ID NO: 41684 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acattttgactaacattcat

SEQ ID NO: 41685 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cattttgactaacattcata

SEQ ID NO: 41686 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
attttgactaacattcataa

SEQ ID NO: 41687 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
attcataagggcaaaacatt

SEQ ID NO: 41688 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcaaaacattcggaacgatt

SEQ ID NO: 41689 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acgatttggaacttgacttg

SEQ ID NO: 41690 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cgatttggaacttgacttgc

SEQ ID NO: 41691 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aggaaaccgtgacccatctg

SEQ ID NO: 41692 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgtggtgttaatacactca

SEQ ID NO: 41693 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatacactcatagaacttgc

SEQ ID NO: 41694 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actcccatgatgctgaatat

SEQ ID NO: 41695 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccatgatgctgaatatcagc

SEQ ID NO: 41696 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgaatatcagccagaatat

SEQ ID NO: 41697 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agccagaatataagacacac

SEQ ID NO: 41698 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagaatataagacacacaag

SEQ ID NO: 41699 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cacaagtagcacattcatga

SEQ ID NO: 41700 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagtagcacattcatgatgg

SEQ ID NO: 41701 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtagcacattcatgatgga

SEQ ID NO: 41702 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atggaaggaattgctcctat

SEQ ID NO: 41703 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgagtgcattcacaacgacc

SEQ ID NO: 41704 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cacaacgacctagtattcaa

SEQ ID NO: 41705 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acgacctagtattcaaaaga

SEQ ID NO: 41706 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctagtattcaaaagaaagaa

SEQ ID NO: 41707 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaagaaagaaaagcatgat

SEQ ID NO: 41708 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaagaaagaaaagcatgatt

SEQ ID NO: 41709 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagaaaagcatgattaggat

SEQ ID NO: 41710 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagcatgattaggattagt

SEQ ID NO: 41711 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aggattagtaagatgttaaa

SEQ ID NO: 41712 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggattagtaagatgttaaat

SEQ ID NO: 41713 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgttaaataggcaacatga

SEQ ID NO: 41714 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacatgaaagaaatgccatg

SEQ ID NO: 41715 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccatgcagacataaataaat

SEQ ID NO: 41716 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagacataaataaattagaa

SEQ ID NO: 41717 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagccgcccttaaatatct

SEQ ID NO: 41718 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atctaagacatcaaaccaac

SEQ ID NO: 41719 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttaaatgcctactctacact

SEQ ID NO: 41720 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatgcctactctacactcag

SEQ ID NO: 41721 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctacactcagcagtgtgcc

SEQ ID NO: 41722 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cactcagcagtgtgccaagc

SEQ ID NO: 41723 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtgccaagcaagacaaaat

SEQ ID NO: 41724 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gacatgaactctgtgatcac

SEQ ID NO: 41725 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acatgaactctgtgatcacc

SEQ ID NO: 41726 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttatcacacaataaaattgt

SEQ ID NO: 41727 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaattgttagcaaaatat

SEQ ID NO: 41728 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatataagacaaaataact

SEQ ID NO: 41729 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaataactaagataatataa

SEQ ID NO: 41730 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaccaaaacctgttattgat

SEQ ID NO: 41731 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
accaaaacctgttattgata

SEQ ID NO: 41732 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cttgtaaaatctgtacactc

SEQ ID NO: 41733 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctgtacactctggaaaaaa

SEQ ID NO: 41734 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttcatgatcctattattac

SEQ ID NO: 41735 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcctattattaccagcatta

SEQ ID NO: 41736 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagcattaaagattccccca

SEQ ID NO: 41737 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcattaaagattcccccata

SEQ ID NO: 41738 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcccccatagagaaactat

SEQ ID NO: 41739 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagaaactattggtgtatat

SEQ ID NO: 41740 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agaaactattggtgtatatc

SEQ ID NO: 41741 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aactattggtgtatatcagg

SEQ ID NO: 41742 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actattggtgtatatcaggt

SEQ ID NO: 41743 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attggtgtatatcaggtagg

SEQ ID NO: 41744 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caggtaggtggaattatgac

SEQ ID NO: 41745 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttttcttattctcttttttt

SEQ ID NO: 41746 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttgagacattctccacaa

SEQ ID NO: 41747 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttgagacattctccacaaa

SEQ ID NO: 41748 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acattctccacaaaaggatt

SEQ ID NO: 41749 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaggattgagaatctttaaa

SEQ ID NO: 41750 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttaaatggtttaaatcctt

SEQ ID NO: 41751 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggtttaaatcctttagatt

SEQ ID NO: 41752 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttaaatcctttagatttggc

SEQ ID NO: 41753 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttggctggttctacgaaat

SEQ ID NO: 41754 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggctggttctacgaaataa

SEQ ID NO: 41755 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actctaaatactttatatgt

SEQ ID NO: 41756 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agcctttgactaaatatata

SEQ ID NO: 41757 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgactaaatatatatagtgc

SEQ ID NO: 41758 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatatatatagtgctggcct

SEQ ID NO: 41759 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatagtgctggcctcagtt

SEQ ID NO: 41760 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcctcagttaagacaaaaat

SEQ ID NO: 41761 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cctcagttaagacaaaaatt

SEQ ID NO: 41762 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttaagacaaaaattaggaa

SEQ ID NO: 41763 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctttctttatttctgctttt

SEQ ID NO: 41764 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttgtactgctattgatcac

SEQ ID NO: 41765 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccagtttgtctttgccactc

SEQ ID NO: 41766 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgccactccagttttcatc

SEQ ID NO: 41767 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgccactccagttttcatcc

SEQ ID NO: 41768 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gccactccagttttcatcca

SEQ ID NO: 41769 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcatccagggcaattcctg

SEQ ID NO: 41770 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgtggcatttaacactctc

SEQ ID NO: 41771 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctacctgtcatcttacactt

SEQ ID NO: 41772 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtcatcttacacttcagctt

SEQ ID NO: 41773 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcagcttgagcacccattc

SEQ ID NO: 41774 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attcaagtacaaatgtgtta

SEQ ID NO: 41775 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtgttaaagattaacctgt

SEQ ID NO: 41776 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtgttaaagattaacctgtt

SEQ ID NO: 41777 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgttaaagattaacctgtta

SEQ ID NO: 41778 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaagattaacctgttaggg

SEQ ID NO: 41779 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaagattaacctgttaggga

SEQ ID NO: 41780 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agattaacctgttagggaag

SEQ ID NO: 41781 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acctgttagggaaggagcac

SEQ ID NO: 41782 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctgttagggaaggagcact

SEQ ID NO: 41783 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttcttttctgcaatgtatt

SEQ ID NO: 41784 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttttctgcaatgtattaag

SEQ ID NO: 41785 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttttctgcaatgtattaagc

SEQ ID NO: 41786 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgtattaagcaggttctc

SEQ ID NO: 41787 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttctcaagatgctttaaaa

SEQ ID NO: 41788 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctcaagatgctttaaaata

SEQ ID NO: 41789 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctttaaaatagagaaatact

SEQ ID NO: 41790 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttaaaatagagaaatacta

SEQ ID NO: 41791 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaggatctctgactactaat

SEQ ID NO: 41792 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgactactaatcagatcatc

SEQ ID NO: 41793 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gactactaatcagatcatct

SEQ ID NO: 41794 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
actactaatcagatcatcta

SEQ ID NO: 41795 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tactaatcagatcatctagg

SEQ ID NO: 41796 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taatcagatcatctagggag

SEQ ID NO: 41797 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatcagatcatctagggaga

SEQ ID NO: 41798 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aacatttttataaatatttt

SEQ ID NO: 41799 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acatttttataaatattttt

SEQ ID NO: 41800 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ataaatatttttaggctttg

SEQ ID NO: 41801 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taaatatttttaggctttgt

SEQ ID NO: 41802 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcaactattcaactctgcca

SEQ ID NO: 41803 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
actattcaactctgccatgg

SEQ ID NO: 41804 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caactctgccatggtagtca

SEQ ID NO: 41805 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aactctgccatggtagtcat

SEQ ID NO: 41806 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgggtcatacataaacaaac

SEQ ID NO: 41807 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catacataaacaaactggta

SEQ ID NO: 41808 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aactggtatggctgtgttcc

SEQ ID NO: 41809 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caagaacatttttacaaaaa

SEQ ID NO: 41810 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagaacatttttacaaaaac

SEQ ID NO: 41811 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acatttttacaaaaacaggc

SEQ ID NO: 41812 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
catttttacaaaaacaggct

SEQ ID NO: 41813 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atttttacaaaaacaggctg

SEQ ID NO: 41814 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggctggggtttgttgacctt

SEQ ID NO: 41815 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gggtttgttgacctttggtc

SEQ ID NO: 41816 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtttgttgacctttggtcca

SEQ ID NO: 41817 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggtccagagcaatgattatt

SEQ ID NO: 41818 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tccagagcaatgattatttg

SEQ ID NO: 41819 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caatgattatttggagttca

SEQ ID NO: 41820 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atttggagttcatggacctg

SEQ ID NO: 41821 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttggagttcatggacctgta

SEQ ID NO: 41822 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggagttcatggacctgtag

SEQ ID NO: 41823 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atggacctgtagaggtttcc

SEQ ID NO: 41824 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tggacctgtagaggtttcct

SEQ ID NO: 41825 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggacctgtagaggtttcctg

SEQ ID NO: 41826 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gacctgtagaggtttcctgg

SEQ ID NO: 41827 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaattatataacaaacatta

SEQ ID NO: 41828 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ttatggttgtgctgtctttc

SEQ ID NO: 41829 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggttgtgctgtctttccgga

SEQ ID NO: 41830 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagacaattctaactttcat

SEQ ID NO: 41831 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taactttcatcagattctta

SEQ ID NO: 41832 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagtctatgtgacctcaaaa

SEQ ID NO: 41833 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatgtgacctcaaaaaagat

SEQ ID NO: 41834 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgtgacctcaaaaaagatt

SEQ ID NO: 41835 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtgacctcaaaaaagattag

SEQ ID NO: 41836 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgacctcaaaaaagattagg

SEQ ID NO: 41837 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcaaaaaagattaggaggaa

SEQ ID NO: 41838 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caaaaaagattaggaggaat

SEQ ID NO: 41839 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagattaggaggaataggaa

SEQ ID NO: 41840 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gattaggaggaataggaata

SEQ ID NO: 41841 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggaataggaatagagaatg

SEQ ID NO: 41842 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggaatagagaatgaagttca

SEQ ID NO: 41843 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atagagaatgaagttcaaag

SEQ ID NO: 41844 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaatgaagttcaaagtagc

SEQ ID NO: 41845 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcaaagtagccagctcttaa

SEQ ID NO: 41846 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaagtagccagctcttaata

SEQ ID NO: 41847 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tccctactatgtttatcacg

SEQ ID NO: 41848 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccctactatgtttatcacgt

SEQ ID NO: 41849 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cgtaggcactctgatacatc

SEQ ID NO: 41850 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatacatctagtcactgacc

SEQ ID NO: 41851 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttctgtgcctccctaccatg

SEQ ID NO: 41852 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgcctatctgcctatgatt

SEQ ID NO: 41853 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgcctatctgcctatgattt

SEQ ID NO: 41854 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcctatctgcctatgatttg

SEQ ID NO: 41855 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgatttggggcttactctt

SEQ ID NO: 41856 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acctccttgtgatgtcttcc

SEQ ID NO: 41857 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gatgtcttcccagacttccc

SEQ ID NO: 41858 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcttcccagacttccccgga

SEQ ID NO: 41859 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cattgaccctactcactctt

SEQ ID NO: 41860 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
attgaccctactcactcttt

SEQ ID NO: 41861 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttgaccctactcactctttg

SEQ ID NO: 41862 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
cctactcactctttggggac

SEQ ID NO: 41863 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctactcactctttggggacc

SEQ ID NO: 41864 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tactcactctttggggaccg

SEQ ID NO: 41865 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atatcacaacacctgacaca

SEQ ID NO: 41866 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cacaacacctgacacatagt

SEQ ID NO: 41867 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatgtttttctaaaaaatgt

SEQ ID NO: 41868 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctaaaaaatgtgagtaatga

SEQ ID NO: 41869 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtgagtaatgatggaatca

SEQ ID NO: 41870 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtgagtaatgatggaatcat

SEQ ID NO: 41871 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgatggaatcatgggtctct

SEQ ID NO: 41872 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggaatcatgggtctctgaga

SEQ ID NO: 41873 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcatgggtctctgagaaaga

SEQ ID NO: 41874 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catgggtctctgagaaagac

SEQ ID NO: 41875 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgagaaagacaggcacctat

SEQ ID NO: 41876 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caggcacctattggtctgat

SEQ ID NO: 41877 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcacctattggtctgatgag

SEQ ID NO: 41878 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctattggtctgatgagaagc

SEQ ID NO: 41879 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggtctgatgagaagccagt

SEQ ID NO: 41880 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggtctgatgagaagccagtt

SEQ ID NO: 41881 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgatgagaagccagttggga

SEQ ID NO: 41882 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaagccagttgggaaagcta

SEQ ID NO: 41883 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agccagttgggaaagctaaa

SEQ ID NO: 41884 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgggaaagctaaagagcct

SEQ ID NO: 41885 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgggaaagctaaagagccta

SEQ ID NO: 41886 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagagcctaaggactcaaac

SEQ ID NO: 41887 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atttcatttatccttcaaaa

SEQ ID NO: 41888 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tatccttcaaaatagccctg

SEQ ID NO: 41889 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aataaatgtctctttttgca

SEQ ID NO: 41890 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggttaacaaatgtaactaaa

SEQ ID NO: 41891 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catccaattcacctgtaata

SEQ ID NO: 41892 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attcacctgtaatacagata

SEQ ID NO: 41893 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtaatacagataaagaaca

SEQ ID NO: 41894 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taatacagataaagaacaaa

SEQ ID NO: 41895 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gataaagaacaaagagcaaa

SEQ ID NO: 41896 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taaagaacaaagagcaaaca

SEQ ID NO: 41897 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaagagcaaacagagttaaa

SEQ ID NO: 41898 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gagcaaacagagttaaatag

SEQ ID NO: 41899 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agcaaacagagttaaatagt

SEQ ID NO: 41900 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aacagagttaaatagtgggc

SEQ ID NO: 41901 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgggctggcttaatcactg

SEQ ID NO: 41902 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgggctggcttaatcactga

SEQ ID NO: 41903 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gctggcttaatcactgaagg

SEQ ID NO: 41904 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggcttaatcactgaaggaag

SEQ ID NO: 41905 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cactgaaggaagtggttttg

SEQ ID NO: 41906 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actgaaggaagtggttttgt

SEQ ID NO: 41907 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctgaaggaagtggttttgta

SEQ ID NO: 41908 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgaaggaagtggttttgtag

SEQ ID NO: 41909 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggaagtggttttgtagggga

SEQ ID NO: 41910 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttgtaggggaaagttgtga

SEQ ID NO: 41911 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctattaatgctcaaaaaatt

SEQ ID NO: 41912 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aacttgtaattttcaacttg

SEQ ID NO: 41913 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtaattttcaacttgtaga

SEQ ID NO: 41914 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catgatctttcttttatact

SEQ ID NO: 41915 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acttggaaaccgttatacac

SEQ ID NO: 41916 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatacactggataattaaaa

SEQ ID NO: 41917 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acactggataattaaaatag

SEQ ID NO: 41918 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
actggataattaaaatagca

SEQ ID NO: 41919 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aattaaaatagcagagattg

SEQ ID NO: 41920 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcagagattgcagtcataat

SEQ ID NO: 41921 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagagattgcagtcataatt

SEQ ID NO: 41922 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgcagtcataattaggtttg

SEQ ID NO: 41923 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcagtcataattaggtttgt

SEQ ID NO: 41924 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cagtcataattaggtttgta

SEQ ID NO: 41925 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aattaggtttgtagggataa

SEQ ID NO: 41926 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggtttgtagggataacagtg

SEQ ID NO: 41927 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagggataacagtgaagatt

SEQ ID NO: 41928 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggataacagtgaagatttgg

SEQ ID NO: 41929 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gataacagtgaagatttggt

SEQ ID NO: 41930 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgaagatttggtaggctga

SEQ ID NO: 41931 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagatctctaatgttcactt

SEQ ID NO: 41932 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agatctctaatgttcacttg

SEQ ID NO: 41933 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctctaatgttcacttgaggc

SEQ ID NO: 41934 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttgaggctggttaaaaccc

SEQ ID NO: 41935 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caagtttcttatccccatcc

SEQ ID NO: 41936 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtttcttatccccatcctg

SEQ ID NO: 41937 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccatcctggagtttctgact

SEQ ID NO: 41938 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcctggagtttctgactcag

SEQ ID NO: 41939 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cctggagtttctgactcagt

SEQ ID NO: 41940 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtttctgactcagtaggtc

SEQ ID NO: 41941 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtttctgactcagtaggtct

SEQ ID NO: 41942 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttctgactcagtaggtctg

SEQ ID NO: 41943 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgactcagtaggtctggggt

SEQ ID NO: 41944 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtaggtctggggtgagatcc

SEQ ID NO: 41945 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttttttttttttttttgata

SEQ ID NO: 41946 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttttttttttttttgataca

SEQ ID NO: 41947 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagagtcttgctctgttccc

SEQ ID NO: 41948 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agagtcttgctctgttcccc

SEQ ID NO: 41949 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcttgctctgttccccaggc

SEQ ID NO: 41950 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgctctgttccccaggctg

SEQ ID NO: 41951 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgttccccaggctggagtg

SEQ ID NO: 41952 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ggagtgcagttgcatgatct

SEQ ID NO: 41953 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tcactgcaacctctgcctcc

SEQ ID NO: 41954 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cactgcaacctctgcctccc

SEQ ID NO: 41955 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacctctgcctcccgggttc

SEQ ID NO: 41956 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcaagcgattcttctgcct

SEQ ID NO: 41957 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttcttctgcctcagcctccc

SEQ ID NO: 41958 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttctgcctcagcctccctag

SEQ ID NO: 41959 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cctcagcctccctagtagct

SEQ ID NO: 41960 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctccctagtagctgagacta

SEQ ID NO: 41961 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tccctagtagctgagactac

SEQ ID NO: 41962 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tagtagctgagactacaggt

SEQ ID NO: 41963 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
caggtgagcaccactatgcc

SEQ ID NO: 41964 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aggtgagcaccactatgccc

SEQ ID NO: 41965 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cgggtaattttttgcatttt

SEQ ID NO: 41966 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtaattttttgcatttttag

SEQ ID NO: 41967 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aattttttgcatttttagta

SEQ ID NO: 41968 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttttgcatttttagtagaga

SEQ ID NO: 41969 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttgcatttttagtagagat

SEQ ID NO: 41970 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttgcatttttagtagagatg

SEQ ID NO: 41971 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gagatggggtttcaccatat

SEQ ID NO: 41972 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tggggtttcaccatattggc

SEQ ID NO: 41973 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggggtttcaccatattggcc

SEQ ID NO: 41974 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttcaccatattggccaggc

SEQ ID NO: 41975 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatccgtccgtctttttaat

SEQ ID NO: 41976 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccgtctttttaataagtttg

SEQ ID NO: 41977 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagtttgtagataatgctaa

SEQ ID NO: 41978 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgtagataatgctaatagc

SEQ ID NO: 41979 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agataatgctaatagctggt

SEQ ID NO: 41980 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggtcagtaaaccacactta

SEQ ID NO: 41981 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtaaaccacacttaaagtat

SEQ ID NO: 41982 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
accacacttaaagtatcagt

SEQ ID NO: 41983 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cacttaaagtatcagtaagc

SEQ ID NO: 41984 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatctccgtgttaaattgct

SEQ ID NO: 41985 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctccgtgttaaattgctca

SEQ ID NO: 41986 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccgtgttaaattgctcagag

SEQ ID NO: 41987 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cgtgttaaattgctcagaga

SEQ ID NO: 41988 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaaattgctcagagaaggt

SEQ ID NO: 41989 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taaattgctcagagaaggta

SEQ ID NO: 41990 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attgctcagagaaggtaagg

SEQ ID NO: 41991 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgctcagagaaggtaaggt

SEQ ID NO: 41992 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgctcagagaaggtaaggta

SEQ ID NO: 41993 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctcagagaaggtaaggtagg

SEQ ID NO: 41994 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcagagaaggtaaggtaggg

SEQ ID NO: 41995 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagaaggtaaggtagggagg

SEQ ID NO: 41996 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggtaaggtagggaggcagtt

SEQ ID NO: 41997 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggcagttaagtaaacaaat

SEQ ID NO: 41998 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taagtaaaatacaatataat

SEQ ID NO: 41999 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagtaaaatacaatataatg

SEQ ID NO: 42000 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atacaatataatgaggattt

SEQ ID NO: 42001 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tacaatataatgaggatttt

SEQ ID NO: 42002 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaggattttaggtgtctgaa

SEQ ID NO: 42003 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggattttaggtgtctgaaca

SEQ ID NO: 42004 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attttaggtgtctgaacaga

SEQ ID NO: 42005 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttaggtgtctgaacagaga

SEQ ID NO: 42006 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgaacagagagagaatatc

SEQ ID NO: 42007 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaatatccagttatgtctcc

SEQ ID NO: 42008 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatccagttatgtctcctgg

SEQ ID NO: 42009 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
cagttatgtctcctggtgga

SEQ ID NO: 42010 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgtctcctggtggacggac

SEQ ID NO: 42011 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtctcctggtggacggaca

SEQ ID NO: 42012 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggacaaggcaactttaaatt

SEQ ID NO: 42013 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caactttaaattgagcctta

SEQ ID NO: 42014 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aactttaaattgagccttaa

SEQ ID NO: 42015 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttaaattgagccttaaagga

SEQ ID NO: 42016 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attgagccttaaaggacaga

SEQ ID NO: 42017 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgagccttaaaggacagat

SEQ ID NO: 42018 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gtgtttgtctgctatacaaa

SEQ ID NO: 42019 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgtttgtctgctatacaaac

SEQ ID NO: 42020 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtctgctatacaaacgggt

SEQ ID NO: 42021 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtctgctatacaaacgggtt

SEQ ID NO: 42022 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tctgctatacaaacgggtta

SEQ ID NO: 42023 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ctatacaaacgggttagggt

SEQ ID NO: 42024 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tatacaaacgggttagggtc

SEQ ID NO: 42025 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caaacgggttagggtcggga

SEQ ID NO: 42026 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaacgggttagggtcgggac

SEQ ID NO: 42027 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aacgggttagggtcgggaca

SEQ ID NO: 42028 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gggttagggtcgggacaggg

SEQ ID NO: 42029 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggttagggtcgggacagggc

SEQ ID NO: 42030 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gttagggtcgggacagggca

SEQ ID NO: 42031 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttagggtcgggacagggcag

SEQ ID NO: 42032 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gggtcgggacagggcagggg

SEQ ID NO: 42033 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acagggcaggggaagcattc

SEQ ID NO: 42034 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcaggggaagcattccagaa

SEQ ID NO: 42035 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aggggaagcattccagaaca

SEQ ID NO: 42036 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggggaagcattccagaacag

SEQ ID NO: 42037 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tccagaacagaggcataaaa

SEQ ID NO: 42038 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaacagaggcataaaatag

SEQ ID NO: 42039 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaacagaggcataaaatagc

SEQ ID NO: 42040 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taaaatagcaggtataaatc

SEQ ID NO: 42041 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaatagcaggtataaatctg

SEQ ID NO: 42042 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagcaggtataaatctggag

SEQ ID NO: 42043 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaatctggagaagaaattt

SEQ ID NO: 42044 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatctggagaagaaatttta

SEQ ID NO: 42045 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atctggagaagaaattttag

SEQ ID NO: 42046 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctggagaagaaattttagag

SEQ ID NO: 42047 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttagaggagtaccaacacat

SEQ ID NO: 42048 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tagaggagtaccaacacatg

SEQ ID NO: 42049 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtaccaacacatgaggata

SEQ ID NO: 42050 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgaggatatggactaatta

SEQ ID NO: 42051 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatggactaattacagaaaa

SEQ ID NO: 42052 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggactaattacagaaaata

SEQ ID NO: 42053 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtcctccatgtgtgttaca

SEQ ID NO: 42054 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catgtgtgttacaaagttgc

SEQ ID NO: 42055 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctggtttaatacaatcctta

SEQ ID NO: 42056 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttaatacaatccttaaagc

SEQ ID NO: 42057 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttaatacaatccttaaagct

SEQ ID NO: 42058 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caatccttaaagctaggtta

SEQ ID NO: 42059 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tccttaaagctaggttatgg

SEQ ID NO: 42060 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cttgtttgtctctgctaatt

SEQ ID NO: 42061 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgctaattgagtatctttt

SEQ ID NO: 42062 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgctaattgagtatcttttc

SEQ ID NO: 42063 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtatcttttcaggcactctg

SEQ ID NO: 42064 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttcaggcactctgcagcct

SEQ ID NO: 42065 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgcagcctaagtgcaaatt

SEQ ID NO: 42066 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcaaattaagtaaactctct

SEQ ID NO: 42067 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taagtaaactctctgagctt

SEQ ID NO: 42068 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tagttttctcaaatataatt

SEQ ID NO: 42069 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tactttgcaatgttatttta

SEQ ID NO: 42070 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actttgcaatgttattttaa

SEQ ID NO: 42071 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaggtgaaattaaatgtga

SEQ ID NO: 42072 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttttctaatgctccttacc

SEQ ID NO: 42073 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttttctaatgctccttaccc

SEQ ID NO: 42074 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctaatgctccttacccagg

SEQ ID NO: 42075 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attatttgaacacctgatat

SEQ ID NO: 42076 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atttgaacacctgatataag

SEQ ID NO: 42077 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttgaacacctgatataagt

SEQ ID NO: 42078 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtccttgattacttatgtat

SEQ ID NO: 42079 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccttgattacttatgtatga

SEQ ID NO: 42080 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttatgtatgagagatgatgt

SEQ ID NO: 42081 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatgtatgagagatgatgtt

SEQ ID NO: 42082 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agagatgatgttaggaacaa

SEQ ID NO: 42083 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caatagtttcccctttcact

SEQ ID NO: 42084 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cccctttcacttggacttcc

SEQ ID NO: 42085 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcacttggacttcctagca

SEQ ID NO: 42086 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcacttggacttcctagcac

SEQ ID NO: 42087 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cacttggacttcctagcaca

SEQ ID NO: 42088 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttggacttcctagcacaggg

SEQ ID NO: 42089 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atttccatttaatatgaaaa

SEQ ID NO: 42090 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatgaaaaaagtcactcatt

SEQ ID NO: 42091 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attctattgtttgacaatat

SEQ ID NO: 42092 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgtttgacaatattagata

SEQ ID NO: 42093 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtttgacaatattagataa

SEQ ID NO: 42094 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgacaatattagataaagg

SEQ ID NO: 42095 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgacaatattagataaaggc

SEQ ID NO: 42096 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtgtatatatatatatata

SEQ ID NO: 42097 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtatatatatatatatata

SEQ ID NO: 42098 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatatatatatatatataga

SEQ ID NO: 42099 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatatatatatatatagaga

SEQ ID NO: 42100 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatatatatatatagagaga

SEQ ID NO: 42101 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatatatatatagagagaga

SEQ ID NO: 42102 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatatatatagagagagaga

SEQ ID NO: 42103 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catatatatactaatatgta

SEQ ID NO: 42104 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atatatgcatattttatata

SEQ ID NO: 42105 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgtatatattaatatataa

SEQ ID NO: 42106 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atataatagtatatactaat

SEQ ID NO: 42107 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taattagtattatacttttt

SEQ ID NO: 42108 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atacttttttagtaatatac

SEQ ID NO: 42109 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atatactagtatatactaat

SEQ ID NO: 42110 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatgagtattatactatttt

SEQ ID NO: 42111 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatttaattaatgctataat

SEQ ID NO: 42112 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tataattagtatttatatat

SEQ ID NO: 42113 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttagtatgcatatataccat

SEQ ID NO: 42114 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ataatatgcatatatactat

SEQ ID NO: 42115 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatatgcatatatatactat

SEQ ID NO: 42116 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccatatatgcatactatata

SEQ ID NO: 42117 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtatatatgcatactgtata

SEQ ID NO: 42118 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtatgtaaatgcatactata

SEQ ID NO: 42119 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtacacacacatacataaa

SEQ ID NO: 42120 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agcctatgtatttatgtaaa

SEQ ID NO: 42121 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttaaaccccattaaaaaat

SEQ ID NO: 42122 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaaaataagaacattata

SEQ ID NO: 42123 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aataagaacattataaagtt

SEQ ID NO: 42124 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taccctcattccttcaaatc

SEQ ID NO: 42125 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcattccttcaaatctagat

SEQ ID NO: 42126 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cattccttcaaatctagata

SEQ ID NO: 42127 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcaaatctagataaggctct

SEQ ID NO: 42128 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaatctagataaggctctta

SEQ ID NO: 42129 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatctagataaggctcttag

SEQ ID NO: 42130 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaggctcttagaggtctta

SEQ ID NO: 42131 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttagaggtcttaaagctct

SEQ ID NO: 42132 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttaaagctctcagtgtccg

SEQ ID NO: 42133 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttaaagctctcagtgtccga

SEQ ID NO: 42134 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taaagctctcagtgtccgaa

SEQ ID NO: 42135 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cagtgtccgaagggatttaa

SEQ ID NO: 42136 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agtgtccgaagggatttaat

SEQ ID NO: 42137 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtgtccgaagggatttaatg

SEQ ID NO: 42138 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cgaagggatttaatggggcc

SEQ ID NO: 42139 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atttaatggggccaagatct

SEQ ID NO: 42140 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taatggggccaagatctgag

SEQ ID NO: 42141 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gggccaagatctgagtagcc

SEQ ID NO: 42142 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gccaagatctgagtagccaa

SEQ ID NO: 42143 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gccaagagtgtttgccacta

SEQ ID NO: 42144 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtttgccactaaagtaacca

SEQ ID NO: 42145 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attgtgtcaataaaatgatg

SEQ ID NO: 42146 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aataaaatgatgaagcataa

SEQ ID NO: 42147 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ataaaatgatgaagcataaa

SEQ ID NO: 42148 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgatgaagcataaaaggaaa

SEQ ID NO: 42149 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcaattctgaaactcactaa

SEQ ID NO: 42150 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actcactaaaagcaactcaa

SEQ ID NO: 42151 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctcactaaaagcaactcaac

SEQ ID NO: 42152 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcaactcaacaggaacaat

SEQ ID NO: 42153 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
actcaacaggaacaataaga

SEQ ID NO: 42154 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gaacaataagatggtatata

SEQ ID NO: 42155 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acaataagatggtatatacg

SEQ ID NO: 42156 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atggtatatacggagttgtg

SEQ ID NO: 42157 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtgtagtcaatgcctaaaaa

SEQ ID NO: 42158 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtagtcaatgcctaaaaat

SEQ ID NO: 42159 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtagtcaatgcctaaaaata

SEQ ID NO: 42160 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcaatgcctaaaaatagggt

SEQ ID NO: 42161 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgcctaaaaatagggtaaga

SEQ ID NO: 42162 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggtaagatggatgtttctgt

SEQ ID NO: 42163 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtaagatggatgtttctgta

SEQ ID NO: 42164 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tggatgtttctgtaaggaaa

SEQ ID NO: 42165 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgtaaggaaatagatttaa

SEQ ID NO: 42166 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaggaaatagatttaaaag

SEQ ID NO: 42167 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaggaaatagatttaaaaga

SEQ ID NO: 42168 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaagaaggttaaccaaaat

SEQ ID NO: 42169 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaaggttaaccaaaataag

SEQ ID NO: 42170 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaataagaagaaataatgt

SEQ ID NO: 42171 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagaagaaataatgtaagca

SEQ ID NO: 42172 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaaataatgtaagcaaagt

SEQ ID NO: 42173 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agttgtttattctatttgaa

SEQ ID NO: 42174 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attaaatctaaaaatttaat

SEQ ID NO: 42175 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taaaaatttaattagaacaa

SEQ ID NO: 42176 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacattttaattataaaact

SEQ ID NO: 42177 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acattttaattataaaactc

SEQ ID NO: 42178 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataaaactcaggtcaaaatg

SEQ ID NO: 42179 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatgaagtgtgtgattctg

SEQ ID NO: 42180 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagtgtgtgattctgaagct

SEQ ID NO: 42181 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attctgaagctaagccctaa

SEQ ID NO: 42182 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaagctaagccctaaaagtg

SEQ ID NO: 42183 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
actcaactaaatctatgtct

SEQ ID NO: 42184 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcttattaaaaaacattttg

SEQ ID NO: 42185 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttttgaagactcatgatttt

SEQ ID NO: 42186 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaagactcatgattttgagt

SEQ ID NO: 42187 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aagactcatgattttgagtt

SEQ ID NO: 42188 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agactcatgattttgagttg

SEQ ID NO: 42189 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agttggggcaaattctcaac

SEQ ID NO: 42190 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttctgccctacaatttcta

SEQ ID NO: 42191 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gccctacaatttctaaagat

SEQ ID NO: 42192 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atttctaaagattagcacca

SEQ ID NO: 42193 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agcaccaaagatctaccaaa

SEQ ID NO: 42194 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atctaccaaatagtttttca

SEQ ID NO: 42195 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tctaccaaatagtttttcat

SEQ ID NO: 42196 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taccaaatagtttttcatgg

SEQ ID NO: 42197 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaaaatcacaattgtactg

SEQ ID NO: 42198 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaatcacaattgtactgaa

SEQ ID NO: 42199 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatcacaattgtactgaaga

SEQ ID NO: 42200 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aattgtactgaagagagaat

SEQ ID NO: 42201 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgtactgaagagagaatga

SEQ ID NO: 42202 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tactgaagagagaatgagag

SEQ ID NO: 42203 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgagagtagctgatctcat

SEQ ID NO: 42204 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cattggcttcacaatcaata

SEQ ID NO: 42205 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acaatcaatatagatataat

SEQ ID NO: 42206 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatcaatatagatataataa

SEQ ID NO: 42207 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taataagagcttcatcatgt

SEQ ID NO: 42208 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagagcttcatcatgttaga

SEQ ID NO: 42209 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttcatcatgttagatagat

SEQ ID NO: 42210 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcagccacaattaccataac

SEQ ID NO: 42211 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaccataaccagtatccaa

SEQ ID NO: 42212 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccagtatccaaaagaaattt

SEQ ID NO: 42213 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcttatcgtaaattatctt

SEQ ID NO: 42214 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatcgtaaattatcttaaga

SEQ ID NO: 42215 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atcttaagaaagaacatgaa

SEQ ID NO: 42216 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatacaatcaatacacattt

SEQ ID NO: 42217 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caatacacattttagttaca

SEQ ID NO: 42218 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cattttagttacaaagcaat

SEQ ID NO: 42219 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatgagctcctccatgacct

SEQ ID NO: 42220 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctcctccatgaccttagatc

SEQ ID NO: 42221 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatatgtttactctctgaat

SEQ ID NO: 42222 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tactctctgaattagttcca

SEQ ID NO: 42223 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catttgcctcacatcctgtg

SEQ ID NO: 42224 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgcctcacatcctgtgtag

SEQ ID NO: 42225 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgcctcacatcctgtgtagc

SEQ ID NO: 42226 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cctcacatcctgtgtagcag

SEQ ID NO: 42227 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtagcaggagacgatgtct

SEQ ID NO: 42228 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgatgtctaagaaaaatgtc

SEQ ID NO: 42229 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taagaaaaatgtctggaatg

SEQ ID NO: 42230 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcagttcttcattacgaat

SEQ ID NO: 42231 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttcttcattacgaataagt

SEQ ID NO: 42232 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttacgaataagttagtgact

SEQ ID NO: 42233 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acgaataagttagtgactga

SEQ ID NO: 42234 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
actgagagattcaatttttc

SEQ ID NO: 42235 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctgagagattcaatttttcg

SEQ ID NO: 42236 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgagagattcaatttttcga

SEQ ID NO: 42237 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagattcaatttttcgaggg

SEQ ID NO: 42238 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcaatttttcgagggaagaa

SEQ ID NO: 42239 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caatttttcgagggaagaat

SEQ ID NO: 42240 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttcgagggaagaataggaa

SEQ ID NO: 42241 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agggaagaataggaacagat

SEQ ID NO: 42242 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggaagaataggaacagatga

SEQ ID NO: 42243 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctttatatatttatctattt

SEQ ID NO: 42244 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttatatatttatctatttc

SEQ ID NO: 42245 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atatttatctatttcaggcg

SEQ ID NO: 42246 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atctatttcaggcgtagaaa

SEQ ID NO: 42247 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaagtcattgttcacaaa

SEQ ID NO: 42248 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagttcattgctgttaccat

SEQ ID NO: 42249 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gttcattgctgttaccatca

SEQ ID NO: 42250 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attgctgttaccatcagaga

SEQ ID NO: 42251 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgctgttaccatcagagac

SEQ ID NO: 42252 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gacaggtaaactgactgatg

SEQ ID NO: 42253 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aggtaaactgactgatgaag

SEQ ID NO: 42254 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggtaaactgactgatgaagc

SEQ ID NO: 42255 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaactgactgatgaagcggg

SEQ ID NO: 42256 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgaagcgggaagtgtttta

SEQ ID NO: 42257 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttaaagtgctcatcctcatg

SEQ ID NO: 42258 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcatcctcatgtagtatttc

SEQ ID NO: 42259 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgtctcactaaatgtaaca

SEQ ID NO: 42260 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttttttttttaaattccta

SEQ ID NO: 42261 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aattcctaaagctacgtatt

SEQ ID NO: 42262 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcctaaagctacgtatttag

SEQ ID NO: 42263 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgccactcttaaatttgcc

SEQ ID NO: 42264 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acatccattattttccactt

SEQ ID NO: 42265 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgtatgctccctctttaat

SEQ ID NO: 42266 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttttttttaatgttttgctg

SEQ ID NO: 42267 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtcccttttgaaactcatgt

SEQ ID NO: 42268 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaacttaattcccaatgtaa

SEQ ID NO: 42269 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attcccaatgtaacagtatt

SEQ ID NO: 42270 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcccaatgtaacagtattaa

SEQ ID NO: 42271 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccaatgtaacagtattaag

SEQ ID NO: 42272 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatgtaacagtattaagagg

SEQ ID NO: 42273 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtaacagtattaagaggca

SEQ ID NO: 42274 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaagaggcagagcctttaa

SEQ ID NO: 42275 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taagaggcagagcctttaaa

SEQ ID NO: 42276 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagagcctttaaaaggtgat

SEQ ID NO: 42277 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agagcctttaaaaggtgatg

SEQ ID NO: 42278 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaaggtgatgaggtcatg

SEQ ID NO: 42279 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaaggtgatgaggtcatga

SEQ ID NO: 42280 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaaggttctgccttcatgaa

SEQ ID NO: 42281 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgccttcatgaatggaata

SEQ ID NO: 42282 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gccttcatgaatggaatata

SEQ ID NO: 42283 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcatgaatggaatatagagt

SEQ ID NO: 42284 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catgaatggaatatagagta

SEQ ID NO: 42285 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgaatggaatatagagtaa

SEQ ID NO: 42286 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatatagagtaagggcttaa

SEQ ID NO: 42287 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atatagagtaagggcttaat

SEQ ID NO: 42288 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagggcttaatgggttatca

SEQ ID NO: 42289 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agggcttaatgggttatcat

SEQ ID NO: 42290 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggcttaatgggttatcatgg

SEQ ID NO: 42291 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taatgggttatcatgggagt

SEQ ID NO: 42292 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gggttatcatgggagtgagt

SEQ ID NO: 42293 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gggagtgagttagatatcac

SEQ ID NO: 42294 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gagtgagttagatatcacaa

SEQ ID NO: 42295 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgagttagatatcacaagag

SEQ ID NO: 42296 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gagttagatatcacaagagt

SEQ ID NO: 42297 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtgggtttattataaaacc

SEQ ID NO: 42298 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtttattataaaacccagtt

SEQ ID NO: 42299 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ataaaacccagtttggctct

SEQ ID NO: 42300 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccctcgccatgtgatgccat

SEQ ID NO: 42301 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtgatgccatgagctgcct

SEQ ID NO: 42302 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtgatgccatgagctgcctt

SEQ ID NO: 42303 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgagctgccttgggactctc

SEQ ID NO: 42304 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggactctctggtgtgcccac

SEQ ID NO: 42305 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctctggtgtgcccaccagc

SEQ ID NO: 42306 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggtgtgcccaccagcaaga

SEQ ID NO: 42307 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
accagcaagaaagttcccac

SEQ ID NO: 42308 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagaaagttcccaccagatg

SEQ ID NO: 42309 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagatgtggacccttcacct

SEQ ID NO: 42310 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acccttcaccttagacttcc

SEQ ID NO: 42311 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
accttagacttcccagcttc

SEQ ID NO: 42312 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcccagcttccagaacttt

SEQ ID NO: 42313 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctttattgaatactttaac

SEQ ID NO: 42314 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgaatactttaaccagtct

SEQ ID NO: 42315 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgaatactttaaccagtctc

SEQ ID NO: 42316 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttaaccagtctcaggtatt

SEQ ID NO: 42317 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagtctcaggtattcagtta

SEQ ID NO: 42318 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtattcagttacagcaataa

SEQ ID NO: 42319 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tattcagttacagcaataaa

SEQ ID NO: 42320 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcagttacagcaataaaagg

SEQ ID NO: 42321 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acagcaataaaaggtagact

SEQ ID NO: 42322 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catgtctgttataattgata

SEQ ID NO: 42323 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacagcccctaaaatactaa

SEQ ID NO: 42324 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acagcccctaaaatactaat

SEQ ID NO: 42325 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tactaataggtctgttctcc

SEQ ID NO: 42326 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgttctccaagccactgtt

SEQ ID NO: 42327 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctccaagccactgttaagt

SEQ ID NO: 42328 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gttaagtgagttttatgaca

SEQ ID NO: 42329 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cggaatatatgcatattatt

SEQ ID NO: 42330 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatgcatattattaagacta

SEQ ID NO: 42331 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atattattaagactatggta

SEQ ID NO: 42332 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctatggtatagtttgtaact

SEQ ID NO: 42333 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acaaatatacgcctgtactg

SEQ ID NO: 42334 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgaagaacactgtttaatc

SEQ ID NO: 42335 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaacactgtttaatcaagt

SEQ ID NO: 42336 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caagtaagtttcaaataacc

SEQ ID NO: 42337 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtaagtttcaaataacccag

SEQ ID NO: 42338 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcaaataacccagaagcctg

SEQ ID NO: 42339 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acccagaagcctgcagaaat

SEQ ID NO: 42340 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaagcctgcagaaatcagac

SEQ ID NO: 42341 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atcagacaagtccattctct

SEQ ID NO: 42342 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agacaagtccattctctgag

SEQ ID NO: 42343 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctctgagtagcaaataatat

SEQ ID NO: 42344 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgagtagcaaataatataag

SEQ ID NO: 42345 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctgaaatctgaatatacaa

SEQ ID NO: 42346 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atatacaacagaatcatctg

SEQ ID NO: 42347 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatacaacagaatcatctgt

SEQ ID NO: 42348 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atacaacagaatcatctgta

SEQ ID NO: 42349 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgatttgccacatccaaccc

SEQ ID NO: 42350 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atttgccacatccaacccca

SEQ ID NO: 42351 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caaccccagagtttctgatt

SEQ ID NO: 42352 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtttctgattcagtatgtct

SEQ ID NO: 42353 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttctgattcagtatgtctt

SEQ ID NO: 42354 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttctgattcagtatgtcttg

SEQ ID NO: 42355 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gattcagtatgtcttggggt

SEQ ID NO: 42356 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
attcagtatgtcttggggtt

SEQ ID NO: 42357 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttcagtatgtcttggggttg

SEQ ID NO: 42358 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcagtatgtcttggggttgg

SEQ ID NO: 42359 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtatgtcttggggttggggg

SEQ ID NO: 42360 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcagaatttgcatctcttat

SEQ ID NO: 42361 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cctacatgtgccaacgtttt

SEQ ID NO: 42362 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtgccaacgttttcagtttt

SEQ ID NO: 42363 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagttttgagaccatccttc

SEQ ID NO: 42364 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tccttcaagaacaactgctg

SEQ ID NO: 42365 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caagaacaactgctgtagat

SEQ ID NO: 42366 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agataagtttctatactttt

SEQ ID NO: 42367 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttttcagaaaaaaaaaaaat

SEQ ID NO: 42368 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cccaaaatttgcatctctgt

SEQ ID NO: 42369 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatttgcatctctgtcagc

SEQ ID NO: 42370 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctgtcagcaagaatattgtg

SEQ ID NO: 42371 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtcagcaagaatattgtgtg

SEQ ID NO: 42372 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tattaaataatatttcaaat

SEQ ID NO: 42373 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttaaataatatttcaaattg

SEQ ID NO: 42374 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcacattacatacccctgaa

SEQ ID NO: 42375 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cacattacatacccctgaac

SEQ ID NO: 42376 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cattacatacccctgaacag

SEQ ID NO: 42377 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attacatacccctgaacagg

SEQ ID NO: 42378 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aacaggaggttatactcact

SEQ ID NO: 42379 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaacaatttccattattaaa

SEQ ID NO: 42380 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catatctcttaatttaaaat

SEQ ID NO: 42381 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttacactgaatgatgaaaat

SEQ ID NO: 42382 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtatttgtgataatatttta

SEQ ID NO: 42383 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaatattgtataatttttt

SEQ ID NO: 42384 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatattgtataattttttaa

SEQ ID NO: 42385 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tattgtataattttttaaga

SEQ ID NO: 42386 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgtataattttttaagaga

SEQ ID NO: 42387 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagagaccccgtcatattta

SEQ ID NO: 42388 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccccgtcatatttacagttt

SEQ ID NO: 42389 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccgtcatatttacagtttaa

SEQ ID NO: 42390 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatttacagtttaagagaa

SEQ ID NO: 42391 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttctataatttcttcttatt

SEQ ID NO: 42392 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tctataatttcttcttattt

SEQ ID NO: 42393 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctataatttcttcttatttg

SEQ ID NO: 42394 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taatttcttcttatttgggg

SEQ ID NO: 42395 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttatcatttttcattttt

SEQ ID NO: 42396 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttatcatttttcatttttt

SEQ ID NO: 42397 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atcatttttcattttttagg

SEQ ID NO: 42398 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttcattttttaggcagtaac

SEQ ID NO: 42399 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgaatgattaattgaaaaa

SEQ ID NO: 42400 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgattaattgaaaaatagc

SEQ ID NO: 42401 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaaatcattactatatccg

SEQ ID NO: 42402 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atcattactatatccgaagt

SEQ ID NO: 42403 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atccgaagttagaattctca

SEQ ID NO: 42404 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccgaagttagaattctcata

SEQ ID NO: 42405 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cgaagttagaattctcatag

SEQ ID NO: 42406 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattctcatagaggaaacct

SEQ ID NO: 42407 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaacctaagataacacatat

SEQ ID NO: 42408 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aacctaagataacacatata

SEQ ID NO: 42409 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cacatataaggtgtaatata

SEQ ID NO: 42410 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttttcacattacatatta

SEQ ID NO: 42411 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acattacatattatagaaaa

SEQ ID NO: 42412 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atttaatatgttgtgtgatt

SEQ ID NO: 42413 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaattattattatttttttt

SEQ ID NO: 42414 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tattattattttttttgaga

SEQ ID NO: 42415 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttattattttttttgagatg

SEQ ID NO: 42416 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggagtctcaccctgtcgccc

SEQ ID NO: 42417 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctcaccctgtcgcccaagc

SEQ ID NO: 42418 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcaccctgtcgcccaagctg

SEQ ID NO: 42419 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgtcgcccaagctggagtg

SEQ ID NO: 42420 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcgcccaagctggagtgcag

SEQ ID NO: 42421 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tcactgaaacctctgcctac

SEQ ID NO: 42422 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cactgaaacctctgcctacc

SEQ ID NO: 42423 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacctctgcctaccgggttc

SEQ ID NO: 42424 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcaagcgattcttctgcct

SEQ ID NO: 42425 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttcttctgcctcagcctcct

SEQ ID NO: 42426 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttctgcctcagcctcctgag

SEQ ID NO: 42427 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcctcagcctcctgagtagc

SEQ ID NO: 42428 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctcagcctcctgagtagct

SEQ ID NO: 42429 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcctgagtagctgggatta

SEQ ID NO: 42430 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcctgagtagctgggattac

SEQ ID NO: 42431 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caggcacctgccaccatgtc

SEQ ID NO: 42432 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggctaattttttgtattttt

SEQ ID NO: 42433 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taattttttgtattttttag

SEQ ID NO: 42434 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attttttgtattttttagta

SEQ ID NO: 42435 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tttgtattttttagtagaga

SEQ ID NO: 42436 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttgtattttttagtagagac

SEQ ID NO: 42437 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgtattttttagtagagacg

SEQ ID NO: 42438 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gagacggggtttcaccatgt

SEQ ID NO: 42439 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cggggtttcaccatgttggc

SEQ ID NO: 42440 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggggtttcaccatgttggcc

SEQ ID NO: 42441 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttcaccatgttggccaggc

SEQ ID NO: 42442 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tggtctcaaactcctgacct

SEQ ID NO: 42443 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggtctcaaactcctgacctc

SEQ ID NO: 42444 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ctcaggtgatccacctgcct

SEQ ID NO: 42445 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccacctgcctcggactctca

SEQ ID NO: 42446 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcctcggactctcaaagtgc

SEQ ID NO: 42447 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctcggactctcaaagtgct

SEQ ID NO: 42448 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctctcaaagtgctgggatta

SEQ ID NO: 42449 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctcaaagtgctgggattac

SEQ ID NO: 42450 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtgctgggattacaggcgt

SEQ ID NO: 42451 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caggcgtgagctaccgcgcc

SEQ ID NO: 42452 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cgtgagctaccgcgcctggc

SEQ ID NO: 42453 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagctaccgcgcctggccag

SEQ ID NO: 42454 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cgcgcctggccagaagccaa

SEQ ID NO: 42455 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccagaagccaaaagtttatg

SEQ ID NO: 42456 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtttatgaagctttgaataa

SEQ ID NO: 42457 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgaagctttgaataacagtt

SEQ ID NO: 42458 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agttgagaaattgaactttt

SEQ ID NO: 42459 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgagtaaatatgactaatt

SEQ ID NO: 42460 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actaatttggtaacattttg

SEQ ID NO: 42461 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atttggtaacattttgcagt

SEQ ID NO: 42462 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgaattcaacttttcttaa

SEQ ID NO: 42463 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agctcgataatgcaaaccct

SEQ ID NO: 42464 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaacccttggttaaatttta

SEQ ID NO: 42465 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttaaattttaaagcacttat

SEQ ID NO: 42466 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtgttgacctctaattatgt

SEQ ID NO: 42467 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgttgacctctaattatgtc

SEQ ID NO: 42468 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taattatgtcaggcatcata

SEQ ID NO: 42469 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctaaaaactatgactgatta

SEQ ID NO: 42470 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taaaaactatgactgattat

SEQ ID NO: 42471 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgtttcttccctaaacaca

SEQ ID NO: 42472 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtttcttccctaaacacaa

SEQ ID NO: 42473 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcttccctaaacacaaaggt

SEQ ID NO: 42474 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttccctaaacacaaaggtt

SEQ ID NO: 42475 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aggttaggtttctgaaaatc

SEQ ID NO: 42476 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaggtttctgaaaatctag

SEQ ID NO: 42477 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttctgaaaatctagaagaat

SEQ ID NO: 42478 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatctagaagaattagtaa

SEQ ID NO: 42479 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaagaattagtaaaagata

SEQ ID NO: 42480 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gataaagaacatatcattct

SEQ ID NO: 42481 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catatcattctgagaaaaat

SEQ ID NO: 42482 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cattctgagaaaaataagac

SEQ ID NO: 42483 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
attctgagaaaaataagact

SEQ ID NO: 42484 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctgagaaaaataagactgg

SEQ ID NO: 42485 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaaataagactgggagatt

SEQ ID NO: 42486 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaataagactgggagattg

SEQ ID NO: 42487 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgaggttataaaataatgt

SEQ ID NO: 42488 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggttataaaataatgtaaga

SEQ ID NO: 42489 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatatgtcatatatattatt

SEQ ID NO: 42490 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttattaaaatataaaataat

SEQ ID NO: 42491 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attaaaatataaaataatta

SEQ ID NO: 42492 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attcaatgaaatgataataa

SEQ ID NO: 42493 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttcaatgaaatgataataat

SEQ ID NO: 42494 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aataatgggtattgtaccgt

SEQ ID NO: 42495 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtaccgttagtttctattt

SEQ ID NO: 42496 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taccgttagtttctatttga

SEQ ID NO: 42497 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgatctcaccgactatttt

SEQ ID NO: 42498 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gatttcttctctatctcaat

SEQ ID NO: 42499 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcttctctatctcaatcag

SEQ ID NO: 42500 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaaaataatatgtaaacta

SEQ ID NO: 42501 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatgtattttccatcatcc

SEQ ID NO: 42502 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tccatcatccaagtattcaa

SEQ ID NO: 42503 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cctctgccccactgccattc

SEQ ID NO: 42504 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctgccccactgccattctg

SEQ ID NO: 42505 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccactgccattctggagatg

SEQ ID NO: 42506 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cactgccattctggagatga

SEQ ID NO: 42507 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
actgccattctggagatgaa

SEQ ID NO: 42508 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccattctggagatgaagggc

SEQ ID NO: 42509 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaagggcaagtcgcatattt

SEQ ID NO: 42510 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggcaagtcgcatatttgaga

SEQ ID NO: 42511 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caagtcgcatatttgagata

SEQ ID NO: 42512 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gagacaattgtgtctcattt

SEQ ID NO: 42513 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attttggtttttcctataat

SEQ ID NO: 42514 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttttggtttttcctataatt

SEQ ID NO: 42515 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttttcctataattgggtct

SEQ ID NO: 42516 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcctataattgggtctgaga

SEQ ID NO: 42517 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttctctctccccaaataca

SEQ ID NO: 42518 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtatttgtataatgatttt

SEQ ID NO: 42519 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatgatttttagaaaaattt

SEQ ID NO: 42520 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaaattttagctcacatat

SEQ ID NO: 42521 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattttgttttattcttaac

SEQ ID NO: 42522 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaaaatcacatctcctttg

SEQ ID NO: 42523 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttataaatgttacaatgtca

SEQ ID NO: 42524 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttctgttctaatattcctca

SEQ ID NO: 42525 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cctcacagatatatttccac

SEQ ID NO: 42526 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggctgtgttaatatttctaa

SEQ ID NO: 42527 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttctaaaagaataaaccta

SEQ ID NO: 42528 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctatagcctgaaaatatatg

SEQ ID NO: 42529 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaaatatgataatatgcaa

SEQ ID NO: 42530 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatatgataatatgcaatag

SEQ ID NO: 42531 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gataatatgcaatagtggtg

SEQ ID NO: 42532 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ataatatgcaatagtggtga

SEQ ID NO: 42533 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaaggttttttcacaacaca

SEQ ID NO: 42534 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttttttcacaacacacagt

SEQ ID NO: 42535 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctcttttaaaatgtactcaa

SEQ ID NO: 42536 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaagtacctacatcaacaat

SEQ ID NO: 42537 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagtacctacatcaacaatt

SEQ ID NO: 42538 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acatcaacaattaggaaatc

SEQ ID NO: 42539 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttaggaaatccagccaacac

SEQ ID NO: 42540 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taggaaatccagccaacacc

SEQ ID NO: 42541 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atccagccaacaccaggcat

SEQ ID NO: 42542 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaccatatgctatccattt

SEQ ID NO: 42543 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccatatgctatccattttag

SEQ ID NO: 42544 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atccattttagaagcatttc

SEQ ID NO: 42545 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttagaagcatttccagaatg

SEQ ID NO: 42546 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catttccagaatgaagatgt

SEQ ID NO: 42547 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccagaatgaagatgtaagtg

SEQ ID NO: 42548 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagatcttgtctgcatactc

SEQ ID NO: 42549 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agatcttgtctgcatactcc

SEQ ID NO: 42550 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atactccaggataatcttaa

SEQ ID NO: 42551 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcaatataaatatcttcaa

SEQ ID NO: 42552 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taaatatcttcaaaagcctg

SEQ ID NO: 42553 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcctgtggaaataatattc

SEQ ID NO: 42554 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtttcaatcatgcacaactt

SEQ ID NO: 42555 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catgattcatttaaaaaaaa

SEQ ID NO: 42556 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgattcatttaaaaaaaac

SEQ ID NO: 42557 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaatacaattctaatgct

SEQ ID NO: 42558 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gctgaaacataatattgaca

SEQ ID NO: 42559 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctgaaacataatattgacat

SEQ ID NO: 42560 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacataatattgacatgggc

SEQ ID NO: 42561 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gggccagctgacattttttc

SEQ ID NO: 42562 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgacattttttctggttta

SEQ ID NO: 42563 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggtttacagttatcatataa

SEQ ID NO: 42564 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacagttatcatataacagt

SEQ ID NO: 42565 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatcatataacagttagttc

SEQ ID NO: 42566 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttagttctagccttctcac

SEQ ID NO: 42567 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cttctcaccagtgctgctgc

SEQ ID NO: 42568 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccagtgctgctgctggtctt

SEQ ID NO: 42569 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtgctgctgctggtcttca

SEQ ID NO: 42570 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtgctgctgctggtcttcag

SEQ ID NO: 42571 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gctgctggtcttcagaggtc

SEQ ID NO: 42572 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgctggtcttcagaggtcaa

SEQ ID NO: 42573 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggtcttcagaggtcaagaga

SEQ ID NO: 42574 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaggtcaagagaaagtgcaa

SEQ ID NO: 42575 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattacttataatccacaaa

SEQ ID NO: 42576 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcctctttctccattaaaat

SEQ ID NO: 42577 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttctccattaaaattggat

SEQ ID NO: 42578 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cattaaaattggataagtcc

SEQ ID NO: 42579 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggataagtcctagcaattt

SEQ ID NO: 42580 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caatttaagacatgatccca

SEQ ID NO: 42581 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttaagacatgatcccatggc

SEQ ID NO: 42582 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acactcccctttttccccac

SEQ ID NO: 42583 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctcccctttttccccaccag

SEQ ID NO: 42584 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcccctttttccccaccagt

SEQ ID NO: 42585 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttttccccaccagtaggatg

SEQ ID NO: 42586 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttccccaccagtaggatgtg

SEQ ID NO: 42587 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aggatgtggagcctgtcttt

SEQ ID NO: 42588 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctcaaatgcttgtgcatcc

SEQ ID NO: 42589 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgcttgtgcatcccagtgcc

SEQ ID NO: 42590 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcctagtaccatgttaataa

SEQ ID NO: 42591 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tagtaccatgttaataacag

SEQ ID NO: 42592 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taccatgttaataacagcag

SEQ ID NO: 42593 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
accatgttaataacagcagc

SEQ ID NO: 42594 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgttaataacagcagcagga

SEQ ID NO: 42595 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gttaataacagcagcaggaa

SEQ ID NO: 42596 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataacagcagcaggaaagga

SEQ ID NO: 42597 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atttgctaaatgaatgactg

SEQ ID NO: 42598 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgctaaatgaatgactgcag

SEQ ID NO: 42599 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaatgactgcagtagcttaa

SEQ ID NO: 42600 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatgactgcagtagcttaat

SEQ ID NO: 42601 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcagtagcttaataggccta

SEQ ID NO: 42602 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttaataggcctatagaaca

SEQ ID NO: 42603 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taataggcctatagaacaca

SEQ ID NO: 42604 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aataggcctatagaacacag

SEQ ID NO: 42605 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ataggcctatagaacacaga

SEQ ID NO: 42606 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catccatatattatccttca

SEQ ID NO: 42607 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatattatccttcaaagctt

SEQ ID NO: 42608 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ttctattctctccattaatg

SEQ ID NO: 42609 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cggtgcttcctatgctttcc

SEQ ID NO: 42610 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctatgctttccaagaaattt

SEQ ID NO: 42611 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gctttccaagaaattttagt

SEQ ID NO: 42612 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acaacattatgtgacaacat

SEQ ID NO: 42613 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caacattatgtgacaacatt

SEQ ID NO: 42614 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attatgtgacaacattaggt

SEQ ID NO: 42615 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taggtgagctctatctaatg

SEQ ID NO: 42616 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aggtgagctctatctaatgt

SEQ ID NO: 42617 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggtgagctctatctaatgta

SEQ ID NO: 42618 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgctttactgttactaattt

SEQ ID NO: 42619 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgtgtatgctcttctgtct

SEQ ID NO: 42620 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtgtatgctcttctgtctg

SEQ ID NO: 42621 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtatgctcttctgtctgag

SEQ ID NO: 42622 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgtctgaggagccacaaca

SEQ ID NO: 42623 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaggagccacaacacagtga

SEQ ID NO: 42624 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aggagccacaacacagtgaa

SEQ ID NO: 42625 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gccacaacacagtgaaagga

SEQ ID NO: 42626 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccacaacacagtgaaaggac

SEQ ID NO: 42627 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cacaacacagtgaaaggaca

SEQ ID NO: 42628 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggacagggtgactttgactt

SEQ ID NO: 42629 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtgactttgactttagactt

SEQ ID NO: 42630 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagccacatgtcccttgaca

SEQ ID NO: 42631 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcccttgacaaagaatttga

SEQ ID NO: 42632 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccttgacaaagaatttgaa

SEQ ID NO: 42633 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atttgaaaggactgaaaaat

SEQ ID NO: 42634 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttgaaaggactgaaaaatt

SEQ ID NO: 42635 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaaattgggctcattgttg

SEQ ID NO: 42636 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attgggctcattgttgcagt

SEQ ID NO: 42637 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gctcattgttgcagtgagcc

SEQ ID NO: 42638 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagatcacgccactgcactc

SEQ ID NO: 42639 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cacgccactgcactccagcc

SEQ ID NO: 42640 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acgccactgcactccagcct

SEQ ID NO: 42641 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgcactccagcctgggcaa

SEQ ID NO: 42642 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcactccagcctgggcaaca

SEQ ID NO: 42643 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tccagcctgggcaacagagc

SEQ ID NO: 42644 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcaaaaaaaaaaaaaaaaaa

SEQ ID NO: 42645 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caaaaaaaaaaaaaaaaaaa

SEQ ID NO: 42646 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaaaaaaaaaaggctcatt

SEQ ID NO: 42647 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaatgattgctgatctcaa

SEQ ID NO: 42648 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaatgattgctgatctcaac

SEQ ID NO: 42649 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgctgatctcaacaggtcta

SEQ ID NO: 42650 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctcaacaggtctaaagtgt

SEQ ID NO: 42651 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtgttagaactttctcttt

SEQ ID NO: 42652 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgaaacactattaaccctgt

SEQ ID NO: 42653 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaccctgttggataaaatga

SEQ ID NO: 42654 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttggataaaatgaaagtca

SEQ ID NO: 42655 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcaaagacctgtatccttcg

SEQ ID NO: 42656 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttatatttattacctgtcta

SEQ ID NO: 42657 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtcatgaacttgtgccatt

SEQ ID NO: 42658 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caatactctaaaattatcct

SEQ ID NO: 42659 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tactctaaaattatccttag

SEQ ID NO: 42660 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaattatccttagcagttt

SEQ ID NO: 42661 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaattatccttagcagtttt

SEQ ID NO: 42662 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagcagttttgggaaactgt

SEQ ID NO: 42663 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aactgttggtatcaatattg

SEQ ID NO: 42664 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttggtatcaatattgaagaa

SEQ ID NO: 42665 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggtatcaatattgaagaaaa

SEQ ID NO: 42666 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caatattgaagaaaagagac

SEQ ID NO: 42667 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attgaagaaaagagacaagt

SEQ ID NO: 42668 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttgaagaaaagagacaagtt

SEQ ID NO: 42669 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgaagaaaagagacaagttg

SEQ ID NO: 42670 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaaaagagacaagttgggg

SEQ ID NO: 42671 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagagacaagttggggcaga

SEQ ID NO: 42672 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gttggggcagaaagactgaa

SEQ ID NO: 42673 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagactgaatggacctact

SEQ ID NO: 42674 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggacctactaagatgcaaa

SEQ ID NO: 42675 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acctactaagatgcaaaaag

SEQ ID NO: 42676 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cctactaagatgcaaaaaga

SEQ ID NO: 42677 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagatgcaaaaagaaggtcc

SEQ ID NO: 42678 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgcaaaaagaaggtcccag

SEQ ID NO: 42679 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaaagaaggtcccagcagt

SEQ ID NO: 42680 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagaaggtcccagcagttgg

SEQ ID NO: 42681 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaaggtcccagcagttggca

SEQ ID NO: 42682 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaggtcccagcagttggcag

SEQ ID NO: 42683 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcagaggttctgaaattcaa

SEQ ID NO: 42684 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctgaaattcaatggaattg

SEQ ID NO: 42685 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aattcaatggaattgaagtg

SEQ ID NO: 42686 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttcaatggaattgaagtgca

SEQ ID NO: 42687 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcaatggaattgaagtgcag

SEQ ID NO: 42688 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caatggaattgaagtgcaga

SEQ ID NO: 42689 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atggaattgaagtgcagagg

SEQ ID NO: 42690 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggaattgaagtgcagaggg

SEQ ID NO: 42691 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaagtgcagagggaggcttc

SEQ ID NO: 42692 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agagggaggcttctagccct

SEQ ID NO: 42693 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagggaggcttctagccctc

SEQ ID NO: 42694 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tccactccacccccaaattc

SEQ ID NO: 42695 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cactccacccccaaattctg

SEQ ID NO: 42696 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actccacccccaaattctgg

SEQ ID NO: 42697 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cccccaaattctggaggaat

SEQ ID NO: 42698 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccccaaattctggaggaatc

SEQ ID NO: 42699 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaattctggaggaatcaggc

SEQ ID NO: 42700 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agccatctaaaccgaaacta

SEQ ID NO: 42701 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccgaaactatggcaatgact

SEQ ID NO: 42702 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gactcagtccttgaaataca

SEQ ID NO: 42703 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agtccttgaaatacaaagac

SEQ ID NO: 42704 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtccttgaaatacaaagaca

SEQ ID NO: 42705 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttgaaatacaaagacaagg

SEQ ID NO: 42706 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgaaatacaaagacaagga

SEQ ID NO: 42707 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgaaatacaaagacaaggaa

SEQ ID NO: 42708 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaaatacaaagacaaggaag

SEQ ID NO: 42709 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acaaagacaaggaaggggct

SEQ ID NO: 42710 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaggaaggggcttagtcac

SEQ ID NO: 42711 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaggaaggggcttagtcaca

SEQ ID NO: 42712 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcttagtcacaaggaaaacg

SEQ ID NO: 42713 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aggaaaacgaagcctgtttc

SEQ ID NO: 42714 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acgaagcctgtttctagaac

SEQ ID NO: 42715 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgtttctagaactggtgta

SEQ ID NO: 42716 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtttctagaactggtgtac

SEQ ID NO: 42717 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtttctagaactggtgtaca

SEQ ID NO: 42718 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctagaactggtgtacagggt

SEQ ID NO: 42719 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaactggtgtacagggtca

SEQ ID NO: 42720 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actggtgtacagggtcagag

SEQ ID NO: 42721 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggtgtacagggtcagagca

SEQ ID NO: 42722 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acagggtcagagcagagccg

SEQ ID NO: 42723 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagggtcagagcagagccgc

SEQ ID NO: 42724 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggtcagagcagagccgcagg

SEQ ID NO: 42725 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccgcaggaagtcttgatgat

SEQ ID NO: 42726 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gatgagaacctctctctgac

SEQ ID NO: 42727 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacctctctctgactggtcc

SEQ ID NO: 42728 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cctctctctgactggtccca

SEQ ID NO: 42729 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctctctgactggtcccagag

SEQ ID NO: 42730 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctctgactggtcccagagc

SEQ ID NO: 42731 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
actggtcccagagcaggaat

SEQ ID NO: 42732 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccagagcaggaattagaatt

SEQ ID NO: 42733 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aggaattagaattcagccca

SEQ ID NO: 42734 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggaattagaattcagcccac

SEQ ID NO: 42735 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaattagaattcagcccaca

SEQ ID NO: 42736 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aattagaattcagcccacag

SEQ ID NO: 42737 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aattcagcccacaggggttc

SEQ ID NO: 42738 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cccacaggggttctagcttc

SEQ ID NO: 42739 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agcttccagaaccaattttg

SEQ ID NO: 42740 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagaaccaattttgtggatg

SEQ ID NO: 42741 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agaaccaattttgtggatgt

SEQ ID NO: 42742 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaccaattttgtggatgtag

SEQ ID NO: 42743 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattttgtggatgtaggagc

SEQ ID NO: 42744 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attttgtggatgtaggagca

SEQ ID NO: 42745 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttgtggatgtaggagcaag

SEQ ID NO: 42746 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgtggatgtaggagcaagg

SEQ ID NO: 42747 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggatgtaggagcaaggaggc

SEQ ID NO: 42748 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aggcaagaatgaccttatgt

SEQ ID NO: 42749 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatgtgagctctatctgatt

SEQ ID NO: 42750 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgtgagctctatctgattt

SEQ ID NO: 42751 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cgctttactgttactaaatt

SEQ ID NO: 42752 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgtgtatactcttctttct

SEQ ID NO: 42753 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtgtatactcttctttctg

SEQ ID NO: 42754 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtatactcttctttctgag

SEQ ID NO: 42755 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctttctgaggagccacaaca

SEQ ID NO: 42756 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggagccacaacacagtgaa

SEQ ID NO: 42757 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cacaacacagtgaaaagata

SEQ ID NO: 42758 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agatatggtgactttgattt

SEQ ID NO: 42759 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttgattttagatgtcaatt

SEQ ID NO: 42760 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttagatgtcaattcagtga

SEQ ID NO: 42761 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtgatagctctgtcatttac

SEQ ID NO: 42762 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gctctgtcatttactagctt

SEQ ID NO: 42763 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctctgtcatttactagcttt

SEQ ID NO: 42764 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttactagctttgggacatt

SEQ ID NO: 42765 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcaacttttaaaactgtacc

SEQ ID NO: 42766 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
actgtacccagcttcatcat

SEQ ID NO: 42767 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcttcatcattggtaaaat

SEQ ID NO: 42768 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agcaaaatatcataatctca

SEQ ID NO: 42769 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcaaaatatcataatctcac

SEQ ID NO: 42770 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caaaatatcataatctcaca

SEQ ID NO: 42771 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gggttgtttgaaaattaaat

SEQ ID NO: 42772 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattaaatgagaaaatctaa

SEQ ID NO: 42773 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaatgagaaaatctaaaag

SEQ ID NO: 42774 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaagattctgaaacacaat

SEQ ID NO: 42775 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttctgaaacacaataagtat

SEQ ID NO: 42776 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acaataagtataagctaaat

SEQ ID NO: 42777 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aataagtataagctaaatga

SEQ ID NO: 42778 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttctttttaacttttattt

SEQ ID NO: 42779 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttctttttaacttttatttt

SEQ ID NO: 42780 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttaacttttattttaggttt

SEQ ID NO: 42781 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taacttttattttaggtttg

SEQ ID NO: 42782 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aacttttattttaggtttga

SEQ ID NO: 42783 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taggtttgagggtacatgtg

SEQ ID NO: 42784 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aggtttgagggtacatgtga

SEQ ID NO: 42785 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acatgtgaaggtttgttaca

SEQ ID NO: 42786 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catgtgaaggtttgttacat

SEQ ID NO: 42787 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acataggtaaacacgtgtca

SEQ ID NO: 42788 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cataggtaaacacgtgtcat

SEQ ID NO: 42789 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ataggtaaacacgtgtcatg

SEQ ID NO: 42790 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taggtaaacacgtgtcatgg

SEQ ID NO: 42791 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgctatacttttaaaaaatc

SEQ ID NO: 42792 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttaaaaaatctagtttaat

SEQ ID NO: 42793 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtttaattggcaacctgtct

SEQ ID NO: 42794 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acctgtctaagtacaaacac

SEQ ID NO: 42795 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttatttaaaatacactttt

SEQ ID NO: 42796 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccaaatgtcttcctctgttt

SEQ ID NO: 42797 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgttttagacattttgaac

SEQ ID NO: 42798 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgttttagacattttgaaca

SEQ ID NO: 42799 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatctcctctctgaaattct

SEQ ID NO: 42800 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaattctcagtcacatatgt

SEQ ID NO: 42801 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctcagtcacatatgtgagt

SEQ ID NO: 42802 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtcacatatgtgagtcagca

SEQ ID NO: 42803 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcacatatgtgagtcagcat

SEQ ID NO: 42804 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagcatgggataaacctcct

SEQ ID NO: 42805 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggataaacctccttagttac

SEQ ID NO: 42806 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gataaacctccttagttact

SEQ ID NO: 42807 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gttactaggaatacattgca

SEQ ID NO: 42808 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
actaggaatacattgcatgg

SEQ ID NO: 42809 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acactatcatgatttctact

SEQ ID NO: 42810 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gatttctacttggatgactc

SEQ ID NO: 42811 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atttctacttggatgactcc

SEQ ID NO: 42812 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctacttggatgactccaggt

SEQ ID NO: 42813 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tacttggatgactccaggta

SEQ ID NO: 42814 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgactccaggtaaggaaaa

SEQ ID NO: 42815 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gactccaggtaaggaaaata

SEQ ID NO: 42816 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgatcacattttctgtttct

SEQ ID NO: 42817 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atcacattttctgtttctga

SEQ ID NO: 42818 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attttctgtttctgagagtt

SEQ ID NO: 42819 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttctgagagttgagacttga

SEQ ID NO: 42820 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctgagagttgagacttgat

SEQ ID NO: 42821 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agagttgagacttgatagga

SEQ ID NO: 42822 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagttgagacttgataggaa

SEQ ID NO: 42823 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgagacttgataggaaagga

SEQ ID NO: 42824 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgataggaaaggaaagcca

SEQ ID NO: 42825 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ataggaaaggaaagccacag

SEQ ID NO: 42826 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taggaaaggaaagccacagt

SEQ ID NO: 42827 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaagccacagtgggtccctg

SEQ ID NO: 42828 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagccacagtgggtccctgc

SEQ ID NO: 42829 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtgggtccctgcaggttgt

SEQ ID NO: 42830 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtgggtccctgcaggttgtt

SEQ ID NO: 42831 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgggtccctgcaggttgttg

SEQ ID NO: 42832 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggtccctgcaggttgttggg

SEQ ID NO: 42833 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggttgttggggagtgtgcc

SEQ ID NO: 42834 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggggagtgtgccaagaatgc

SEQ ID NO: 42835 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gggagtgtgccaagaatgcc

SEQ ID NO: 42836 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggctctgcctgctccttacc

SEQ ID NO: 42837 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gctctgcctgctccttacct

SEQ ID NO: 42838 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tccttacctaggacattcct

SEQ ID NO: 42839 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccttacctaggacattcctc

SEQ ID NO: 42840 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cttacctaggacattcctca

SEQ ID NO: 42841 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attcctcagggttgtgtttg

SEQ ID NO: 42842 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctcagggttgtgtttgcagt

SEQ ID NO: 42843 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtttgcagtgagcaacctt

SEQ ID NO: 42844 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtgagcaaccttgagacat

SEQ ID NO: 42845 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtgagcaaccttgagacatg

SEQ ID NO: 42846 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agcaaccttgagacatgagg

SEQ ID NO: 42847 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcaaccttgagacatgaggt

SEQ ID NO: 42848 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caaccttgagacatgaggta

SEQ ID NO: 42849 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gagacatgaggtagggtctc

SEQ ID NO: 42850 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agacatgaggtagggtctct

SEQ ID NO: 42851 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaggtagggtctctgggaca

SEQ ID NO: 42852 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggtagggtctctgggacaaa

SEQ ID NO: 42853 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agggtctctgggacaaagag

SEQ ID NO: 42854 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gggtctctgggacaaagagc

SEQ ID NO: 42855 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggtctctgggacaaagagca

SEQ ID NO: 42856 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcagggttgcttatgttgct

SEQ ID NO: 42857 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcttatgttgcttggtataa

SEQ ID NO: 42858 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttatgttgcttggtataaa

SEQ ID NO: 42859 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tataaaaggatgcattccct

SEQ ID NO: 42860 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaggatgcattccctaagct

SEQ ID NO: 42861 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tccctaagctcagtgttcct

SEQ ID NO: 42862 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatatgtgtacacactcatt

SEQ ID NO: 42863 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atatgtgtacacactcattc

SEQ ID NO: 42864 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggctcatataatgcccccat

SEQ ID NO: 42865 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tataatgcccccatgagacc

SEQ ID NO: 42866 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ataatgcccccatgagacct

SEQ ID NO: 42867 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcccccatgagacctgggta

SEQ ID NO: 42868 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccccatgagacctgggtaa

SEQ ID NO: 42869 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccccatgagacctgggtaaa

SEQ ID NO: 42870 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cccatgagacctgggtaaag

SEQ ID NO: 42871 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccatgagacctgggtaaagg

SEQ ID NO: 42872 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgggtaaagggggaaccaa

SEQ ID NO: 42873 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcatgctactttccacacat

SEQ ID NO: 42874 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctttccacacataagtaaca

SEQ ID NO: 42875 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagtcctttatctctgaccc

SEQ ID NO: 42876 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagcacctcatatcttctgc

SEQ ID NO: 42877 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttctgccagcatccatgaaa

SEQ ID NO: 42878 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagcatccatgaaacagtat

SEQ ID NO: 42879 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acagtatcagatcaacctat

SEQ ID NO: 42880 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agatcaacctattagcatat

SEQ ID NO: 42881 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacctattagcatataagta

SEQ ID NO: 42882 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atataagtacagtaaaatca

SEQ ID NO: 42883 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatcaaagtccaaactcatg

SEQ ID NO: 42884 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aactcatgaagactgtctat

SEQ ID NO: 42885 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actcatgaagactgtctatg

SEQ ID NO: 42886 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgaagactgtctatgaggc

SEQ ID NO: 42887 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtctatgaggcaagttaca

SEQ ID NO: 42888 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aggcaagttacaaagttctt

SEQ ID NO: 42889 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttcttgagtattctatttt

SEQ ID NO: 42890 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttttagtataatgaaacttc

SEQ ID NO: 42891 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagtataatgaaacttccag

SEQ ID NO: 42892 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaaacttccagtggtatatc

SEQ ID NO: 42893 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttccagtggtatatctagc

SEQ ID NO: 42894 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtggtatatctagctagatc

SEQ ID NO: 42895 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tggtatatctagctagatct

SEQ ID NO: 42896 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agctagatctgggctcctaa

SEQ ID NO: 42897 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gggctcctaatggcttctaa

SEQ ID NO: 42898 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttctaatggctcatctctgt

SEQ ID NO: 42899 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tggctcatctctgtcagcgt

SEQ ID NO: 42900 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcatctctgtcagcgtcag

SEQ ID NO: 42901 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcatctctgtcagcgtcagc

SEQ ID NO: 42902 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagcaggaaaaatgacaatt

SEQ ID NO: 42903 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaaaatgacaattaagaaa

SEQ ID NO: 42904 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaaatgacaattaagaaaa

SEQ ID NO: 42905 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgacaattaagaaaaaggtt

SEQ ID NO: 42906 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gacaattaagaaaaaggttc

SEQ ID NO: 42907 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aattaagaaaaaggttcagg

SEQ ID NO: 42908 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caggtagcttgtaattctac

SEQ ID NO: 42909 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagatctctttcaactctca

SEQ ID NO: 42910 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atctctttcaactctcatgg

SEQ ID NO: 42911 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaagctgcttgtatgtgtac

SEQ ID NO: 42912 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcttgtatgtgtacaagaat

SEQ ID NO: 42913 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttccctttttataacacac

SEQ ID NO: 42914 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taacacacaagatgcttcac

SEQ ID NO: 42915 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagctgaccttgctttctca

SEQ ID NO: 42916 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgctttctcatagtatctc

SEQ ID NO: 42917 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcttcttcccaccacacttg

SEQ ID NO: 42918 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcccaccacacttgcagtt

SEQ ID NO: 42919 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccaccacacttgcagttcag

SEQ ID NO: 42920 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gattgtatacttgttcccct

SEQ ID NO: 42921 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctcagcctgccttgcctaac

SEQ ID NO: 42922 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaattcctgttcgtctttc

SEQ ID NO: 42923 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcgtctttctagaccctgaa

SEQ ID NO: 42924 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atttacgtttctgaaattgc

SEQ ID NO: 42925 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tacgtttctgaaattgcaag

SEQ ID NO: 42926 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agcagttgttctccttgcta

SEQ ID NO: 42927 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctttgcttacaaacacatcc

SEQ ID NO: 42928 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acaaacacatccaagctcta

SEQ ID NO: 42929 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cttctcttctccattgctct

SEQ ID NO: 42930 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tccattgctctgagctcctt

SEQ ID NO: 42931 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgagctccttaagaataaa

SEQ ID NO: 42932 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccttaagaataaacagtacc

SEQ ID NO: 42933 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatttatctttgcattgtga

SEQ ID NO: 42934 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgaaagttgatcatacaaat

SEQ ID NO: 42935 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaaagttgatcatacaaatt

SEQ ID NO: 42936 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agttgatcatacaaattggg

SEQ ID NO: 42937 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcttgtcctactcaactaa

SEQ ID NO: 42938 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tactcaactaacagtcaact

SEQ ID NO: 42939 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctcaactaacagtcaactaa

SEQ ID NO: 42940 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctaacagtcaactaagagtc

SEQ ID NO: 42941 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acagtcaactaagagtcaag

SEQ ID NO: 42942 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagtcaactaagagtcaaga

SEQ ID NO: 42943 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcaactaagagtcaagaagg

SEQ ID NO: 42944 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caactaagagtcaagaaggc

SEQ ID NO: 42945 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aactaagagtcaagaaggca

SEQ ID NO: 42946 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
actaagagtcaagaaggcag

SEQ ID NO: 42947 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctaagagtcaagaaggcagg

SEQ ID NO: 42948 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agtcaagaaggcagggggaa

SEQ ID NO: 42949 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaggcagggggaaaagctct

SEQ ID NO: 42950 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aggcagggggaaaagctctc

SEQ ID NO: 42951 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggcagggggaaaagctctca

SEQ ID NO: 42952 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agggtacaaaacattactcc

SEQ ID NO: 42953 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caagaattataattctctgc

SEQ ID NO: 42954 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctctgcaagactgactgttg

SEQ ID NO: 42955 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgcttgttgtaacttgaaat

SEQ ID NO: 42956 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttgaaattagttttatcta

SEQ ID NO: 42957 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tagttttatctatagcttct

SEQ ID NO: 42958 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agttttatctatagcttctg

SEQ ID NO: 42959 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgaggaaacctgttacactc

SEQ ID NO: 42960 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaggaaacctgttacactct

SEQ ID NO: 42961 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgccaacgactgttgctcgc

SEQ ID NO: 42962 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aacgactgttgctcgccagt

SEQ ID NO: 42963 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cgactgttgctcgccagttg

SEQ ID NO: 42964 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gctcgccagttggagcttac

SEQ ID NO: 42965 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttggagcttaccagttccc

SEQ ID NO: 42966 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccagttccccagatccttac

SEQ ID NO: 42967 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagttccccagatccttact

SEQ ID NO: 42968 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agttccccagatccttacta

SEQ ID NO: 42969 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agggccaatgaactttctca

SEQ ID NO: 42970 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggccaatgaactttctcaaa

SEQ ID NO: 42971 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaccttctctctttgttcta

SEQ ID NO: 42972 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
accttctctctttgttctac

SEQ ID NO: 42973 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccttctctctttgttctaca

SEQ ID NO: 42974 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctctctttgttctacaggga

SEQ ID NO: 42975 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttctacagggaaagtgcttt

SEQ ID NO: 42976 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtgctttcagtttatgcca

SEQ ID NO: 42977 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttttgcaaactgatattgc

SEQ ID NO: 42978 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaaattctcttttctatta

SEQ ID NO: 42979 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcttttctattatagccatc

SEQ ID NO: 42980 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cttttctattatagccatct

SEQ ID NO: 42981 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttctattatagccatctggg

SEQ ID NO: 42982 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagccatctgggtggtcctt

SEQ ID NO: 42983 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgggtggtcctttggacaa

SEQ ID NO: 42984 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtcctttggacaacagcatt

SEQ ID NO: 42985 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcctttggacaacagcattc

SEQ ID NO: 42986 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctttggacaacagcattca

SEQ ID NO: 42987 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttggacaacagcattcaggg

SEQ ID NO: 42988 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acaacagcattcagggcagc

SEQ ID NO: 42989 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caacagcattcagggcagca

SEQ ID NO: 42990 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agggcagcaaggataatgcc

SEQ ID NO: 42991 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caaggataatgcctggcatg

SEQ ID NO: 42992 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaggataatgcctggcatgt

SEQ ID NO: 42993 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggataatgcctggcatgtag

SEQ ID NO: 42994 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcctggcatgtaggagtgct

SEQ ID NO: 42995 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtgctcagtaactatttact

SEQ ID NO: 42996 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agtaactatttactgagctc

SEQ ID NO: 42997 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctcaagtaaaattttgtcat

SEQ ID NO: 42998 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttgtcattggcactaatca

SEQ ID NO: 42999 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgtcattggcactaatcat

SEQ ID NO: 43000 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgtcattggcactaatcata

SEQ ID NO: 43001 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctaatcatagggattaattc

SEQ ID NO: 43002 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taatcatagggattaattct

SEQ ID NO: 43003 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gccatgatatttttatcttt

SEQ ID NO: 43004 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatcttttagctcatttta

SEQ ID NO: 43005 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acttaatcaatatattgact

SEQ ID NO: 43006 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttaatcaatatattgactt

SEQ ID NO: 43007 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caatatattgacttaggtgt

SEQ ID NO: 43008 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttaggtgtcagatcatttac

SEQ ID NO: 43009 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taggtgtcagatcatttacc

SEQ ID NO: 43010 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aggtgtcagatcatttacca

SEQ ID NO: 43011 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttaccagggcaccactgct

SEQ ID NO: 43012 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
accagggcaccactgctgag

SEQ ID NO: 43013 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccagggcaccactgctgagc

SEQ ID NO: 43014 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccactgctgagcaggatcat

SEQ ID NO: 43015 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cactgctgagcaggatcatg

SEQ ID NO: 43016 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcaggatcatgaggacaatg

SEQ ID NO: 43017 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aactgtgttcaacaatcttg

SEQ ID NO: 43018 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtgttcaacaatcttgtag

SEQ ID NO: 43019 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtgttcaacaatcttgtagc

SEQ ID NO: 43020 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aggttttcctgatgttccac

SEQ ID NO: 43021 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tccctgactctatgttaact

SEQ ID NO: 43022 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgactctatgttaacttgg

SEQ ID NO: 43023 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctatgttaacttggcagcat

SEQ ID NO: 43024 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acctccatacacaacctgac

SEQ ID NO: 43025 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccatacacaacctgacaaga

SEQ ID NO: 43026 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcatgttaaatcttgatatt

SEQ ID NO: 43027 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacacctatacttgcaattt

SEQ ID NO: 43028 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cctatacttgcaatttcaga

SEQ ID NO: 43029 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatttcagatagatttaatt

SEQ ID NO: 43030 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttgcatgatgttttctaaa

SEQ ID NO: 43031 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gatgttttctaaatagttgt

SEQ ID NO: 43032 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttctaaatagttgttagt

SEQ ID NO: 43033 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatagttgttagttagttt

SEQ ID NO: 43034 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtaatccccaatttctctt

SEQ ID NO: 43035 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttctcttcagtctcctcca

SEQ ID NO: 43036 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgaatgaactaaaatctg

SEQ ID NO: 43037 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctgaagacgacatgaattt

SEQ ID NO: 43038 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctgaagacgacatgaatttt

SEQ ID NO: 43039 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgaagacgacatgaatttta

SEQ ID NO: 43040 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttagggtcttcttttctga

SEQ ID NO: 43041 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttctgacagataaatttttc

SEQ ID NO: 43042 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atttttctagtctataattt

SEQ ID NO: 43043 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagatacttccactcctcta

SEQ ID NO: 43044 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acacctttctaaacaatatt

SEQ ID NO: 43045 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctaaacaatattgagaaaat

SEQ ID NO: 43046 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aacaatattgagaaaattag

SEQ ID NO: 43047 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagtggaaactcctgaaatt

SEQ ID NO: 43048 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actcctgaaattaagttcaa

SEQ ID NO: 43049 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caaaagaaactcatcttgat

SEQ ID NO: 43050 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagaaactcatcttgattag

SEQ ID NO: 43051 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcatcttgattagaagatc

SEQ ID NO: 43052 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatccagatgaaactgtttc

SEQ ID NO: 43053 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaactgtttcaagtattct

SEQ ID NO: 43054 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgaaaattgtacttaaaaa

SEQ ID NO: 43055 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaattgtacttaaaaatggt

SEQ ID NO: 43056 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aattgtacttaaaaatggtt

SEQ ID NO: 43057 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtacatgatttcctttcct

SEQ ID NO: 43058 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttcctcagtgaatttatgt

SEQ ID NO: 43059 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttcctcagtgaatttatgtt

SEQ ID NO: 43060 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtgaatttatgttaggttt

SEQ ID NO: 43061 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatttatgttaggttttggt

SEQ ID NO: 43062 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atttatgttaggttttggtt

SEQ ID NO: 43063 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatgttaggttttggttagg

SEQ ID NO: 43064 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttggttaggtagataaaaa

SEQ ID NO: 43065 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagaaataaatgactataac

SEQ ID NO: 43066 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taaatgactataactagata

SEQ ID NO: 43067 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataactagatatggcaacta

SEQ ID NO: 43068 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agatatggcaactaaagtga

SEQ ID NO: 43069 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atggcaactaaagtgacaga

SEQ ID NO: 43070 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caactaaagtgacagatagt

SEQ ID NO: 43071 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aactaaagtgacagatagtc

SEQ ID NO: 43072 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
actaaagtgacagatagtca

SEQ ID NO: 43073 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atagtcagggttcattttga

SEQ ID NO: 43074 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cagggttcattttgatagca

SEQ ID NO: 43075 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggttcattttgatagcatgg

SEQ ID NO: 43076 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggaagaaatcaatctcacc

SEQ ID NO: 43077 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctcacctggcttatttctt

SEQ ID NO: 43078 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acctggcttatttcttgaga

SEQ ID NO: 43079 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctggcttatttcttgagaaa

SEQ ID NO: 43080 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggcttatttcttgagaaaga

SEQ ID NO: 43081 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atttcttgagaaagagagat

SEQ ID NO: 43082 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcttgagaaagagagatcag

SEQ ID NO: 43083 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgagaaagagagatcagta

SEQ ID NO: 43084 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgagaaagagagatcagtag

SEQ ID NO: 43085 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agagatcagtagaggcttcc

SEQ ID NO: 43086 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatcagtagaggcttcctag

SEQ ID NO: 43087 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcagtagaggcttcctagaa

SEQ ID NO: 43088 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagaggcttcctagaagaga

SEQ ID NO: 43089 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaggcttcctagaagagatg

SEQ ID NO: 43090 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcctagaagagatggagcc

SEQ ID NO: 43091 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcctagaagagatggagcct

SEQ ID NO: 43092 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cctgggttgaatcaaaatat

SEQ ID NO: 43093 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaatcaaaatatcagtaaaa

SEQ ID NO: 43094 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atcaaaatatcagtaaaaaa

SEQ ID NO: 43095 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatatcagtaaaaaagagtt

SEQ ID NO: 43096 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atatcagtaaaaaagagttt

SEQ ID NO: 43097 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcagtaaaaaagagtttggg

SEQ ID NO: 43098 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaagagtttgggtggaattc

SEQ ID NO: 43099 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagagtttgggtggaattcc

SEQ ID NO: 43100 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtttgggtggaattccagg

SEQ ID NO: 43101 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcagcaaaaattgttatgca

SEQ ID NO: 43102 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttatgcatagaaatttaaac

SEQ ID NO: 43103 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catagaaatttaaaccagtt

SEQ ID NO: 43104 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccagtttagaattgtgatgc

SEQ ID NO: 43105 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtttagaattgtgatgcaag

SEQ ID NO: 43106 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatgcaagcagaatgtacac

SEQ ID NO: 43107 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgcaagcagaatgtacacaa

SEQ ID NO: 43108 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcaagcagaatgtacacaag

SEQ ID NO: 43109 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcagaatgtacacaagaggc

SEQ ID NO: 43110 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagaatgtacacaagaggca

SEQ ID NO: 43111 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agaatgtacacaagaggcaa

SEQ ID NO: 43112 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtacacaagaggcaagggt

SEQ ID NO: 43113 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tacacaagaggcaagggtga

SEQ ID NO: 43114 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acacaagaggcaagggtgag

SEQ ID NO: 43115 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagaggcaagggtgagaggt

SEQ ID NO: 43116 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcaagggtgagaggtgagct

SEQ ID NO: 43117 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agaggtgagcttagaaaaat

SEQ ID NO: 43118 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtgagcttagaaaaattggt

SEQ ID NO: 43119 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagaaaaattggtcagatta

SEQ ID NO: 43120 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaattggtcagattatgga

SEQ ID NO: 43121 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggtcagattatggaaagcat

SEQ ID NO: 43122 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagcattggcctttacctt

SEQ ID NO: 43123 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagcattggcctttacctta

SEQ ID NO: 43124 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcattggcctttaccttaag

SEQ ID NO: 43125 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggcctttaccttaaggagtt

SEQ ID NO: 43126 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtttggcttatatcctatt

SEQ ID NO: 43127 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtttggcttatatcctattg

SEQ ID NO: 43128 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcttatatcctattgaggtt

SEQ ID NO: 43129 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttatatcctattgaggttg

SEQ ID NO: 43130 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatatcctattgaggttgag

SEQ ID NO: 43131 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcctattgaggttgaggagt

SEQ ID NO: 43132 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgaggttgaggagtaagta

SEQ ID NO: 43133 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgaggttgaggagtaagtaa

SEQ ID NO: 43134 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaggttgaggagtaagtaaa

SEQ ID NO: 43135 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggagtaagtaaagggttat

SEQ ID NO: 43136 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtaagtaaagggttataag

SEQ ID NO: 43137 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtaagtaaagggttataagc

SEQ ID NO: 43138 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taagtaaagggttataagca

SEQ ID NO: 43139 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagggttataagcagggaac

SEQ ID NO: 43140 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacgcaaattgcaatgtaaa

SEQ ID NO: 43141 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aatgtaaatagatgtctcca

SEQ ID NO: 43142 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atagatgtctccacggtaca

SEQ ID NO: 43143 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agatgtctccacggtacatg

SEQ ID NO: 43144 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gatgtctccacggtacatgg

SEQ ID NO: 43145 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctccacggtacatggaggat

SEQ ID NO: 43146 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acggtacatggaggataagt

SEQ ID NO: 43147 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtacatggaggataagttgg

SEQ ID NO: 43148 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tacatggaggataagttgga

SEQ ID NO: 43149 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acatggaggataagttggaa

SEQ ID NO: 43150 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggataagttggaagggtgaa

SEQ ID NO: 43151 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ataagttggaagggtgaata

SEQ ID NO: 43152 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagttggaagggtgaataga

SEQ ID NO: 43153 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agttggaagggtgaatagag

SEQ ID NO: 43154 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttggaagggtgaatagagag

SEQ ID NO: 43155 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaagggtgaatagagaggag

SEQ ID NO: 43156 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagggtgaatagagaggagt

SEQ ID NO: 43157 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agggtgaatagagaggagta

SEQ ID NO: 43158 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gggtgaatagagaggagtag

SEQ ID NO: 43159 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatagagaggagtaggggtg

SEQ ID NO: 43160 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagaggagtaggggtgaaga

SEQ ID NO: 43161 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggtgaagaaagtttcatacc

SEQ ID NO: 43162 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcatacccagaaaaccatt

SEQ ID NO: 43163 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccagaaaaccatttggattc

SEQ ID NO: 43164 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaccatttggattctggtc

SEQ ID NO: 43165 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttctggtccagtatcctgtc

SEQ ID NO: 43166 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctggtccagtatcctgtctg

SEQ ID NO: 43167 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggtccagtatcctgtctgg

SEQ ID NO: 43168 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggtccagtatcctgtctgga

SEQ ID NO: 43169 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagtatcctgtctggaggga

SEQ ID NO: 43170 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcctgtctggagggaaagat

SEQ ID NO: 43171 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtctggagggaaagattagt

SEQ ID NO: 43172 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctggagggaaagattagtt

SEQ ID NO: 43173 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gggaaagattagttaggaac

SEQ ID NO: 43174 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaaagattagttaggaacta

SEQ ID NO: 43175 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttaggaactagagttgtaa

SEQ ID NO: 43176 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actagagttgtaacagattc

SEQ ID NO: 43177 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taacagattcaagacatatt

SEQ ID NO: 43178 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagattcaagacatatttgg

SEQ ID NO: 43179 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acatatttggcagataaaat

SEQ ID NO: 43180 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatttggcagataaaatcag

SEQ ID NO: 43181 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atttggcagataaaatcagc

SEQ ID NO: 43182 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cagataaaatcagcaggatt

SEQ ID NO: 43183 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agcaggatttggtgattgat

SEQ ID NO: 43184 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attgattggatatcaaatgt

SEQ ID NO: 43185 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgattggatatcaaatgtaa

SEQ ID NO: 43186 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggatatcaaatgtaagaga

SEQ ID NO: 43187 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggatatcaaatgtaagagaa

SEQ ID NO: 43188 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatcaaatgtaagagaaagg

SEQ ID NO: 43189 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atcaaatgtaagagaaagga

SEQ ID NO: 43190 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtaagagaaaggaaggatcc

SEQ ID NO: 43191 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taagagaaaggaaggatccc

SEQ ID NO: 43192 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aggaaggatcccaggactac

SEQ ID NO: 43193 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggaaggatcccaggactacc

SEQ ID NO: 43194 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aggatcccaggactaccagg

SEQ ID NO: 43195 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caggactaccaggtggatgt

SEQ ID NO: 43196 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gactaccaggtggatgttag

SEQ ID NO: 43197 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tagcagtgaattgaaaacca

SEQ ID NO: 43198 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agcagtgaattgaaaaccac

SEQ ID NO: 43199 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagtgaattgaaaaccacag

SEQ ID NO: 43200 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtgaattgaaaaccacagg

SEQ ID NO: 43201 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgaattgaaaaccacaggag

SEQ ID NO: 43202 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaattgaaaaccacaggagg

SEQ ID NO: 43203 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attgaaaaccacaggaggag

SEQ ID NO: 43204 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
cacaggaggaggagctgact

SEQ ID NO: 43205 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aggaggaggagctgactcgg

SEQ ID NO: 43206 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggaggaggagctgactcggc

SEQ ID NO: 43207 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
actcggcaggtaatgatttt

SEQ ID NO: 43208 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcctgtgaattgtttaaata

SEQ ID NO: 43209 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtttaaatacagatatccta

SEQ ID NO: 43210 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatcctatagattttaaaaa

SEQ ID NO: 43211 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atcctatagattttaaaaat

SEQ ID NO: 43212 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcctatagattttaaaaatg

SEQ ID NO: 43213 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctatagattttaaaaatgg

SEQ ID NO: 43214 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atagattttaaaaatggggg

SEQ ID NO: 43215 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tagattttaaaaatgggggt

SEQ ID NO: 43216 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
atgggggtgggaacctgaaa

SEQ ID NO: 43217 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgggggtgggaacctgaaac

SEQ ID NO: 43218 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgaaacgggaaaaacctgtc

SEQ ID NO: 43219 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cgggaaaaacctgtctagaa

SEQ ID NO: 43220 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cctgtctagaaaagaattct

SEQ ID NO: 43221 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaagaattcttagtaataat

SEQ ID NO: 43222 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagcatacatgtatctgctg

SEQ ID NO: 43223 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atacatgtatctgctgaagt

SEQ ID NO: 43224 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtatctgctgaagtcagaa

SEQ ID NO: 43225 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgaagtcagaacagttttt

SEQ ID NO: 43226 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgaagtcagaacagtttttg

SEQ ID NO: 43227 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agtttttgaggtcacacaaa

SEQ ID NO: 43228 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttttgaggtcacacaaaaa

SEQ ID NO: 43229 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggtcacacaaaaagagtatt

SEQ ID NO: 43230 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtcacacaaaaagagtattt

SEQ ID NO: 43231 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcacacaaaaagagtattta

SEQ ID NO: 43232 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acaaaaagagtatttagggt

SEQ ID NO: 43233 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaagagtatttagggtgag

SEQ ID NO: 43234 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtatttagggtgagcagaaa

SEQ ID NO: 43235 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatttagggtgagcagaaaa

SEQ ID NO: 43236 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atttagggtgagcagaaaaa

SEQ ID NO: 43237 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cattctgaaacaacaatatt

SEQ ID NO: 43238 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attctgaaacaacaatatta

SEQ ID NO: 43239 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttctgaaacaacaatattaa

SEQ ID NO: 43240 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgaaacaacaatattaagg

SEQ ID NO: 43241 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaaacaacaatattaaggga

SEQ ID NO: 43242 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tattaagggagagaattcaa

SEQ ID NO: 43243 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaattcaatggtgtgctga

SEQ ID NO: 43244 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attcaatggtgtgctgaaag

SEQ ID NO: 43245 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aattcttgttgttaaactgt

SEQ ID NO: 43246 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcctgcttgtctgttgttaa

SEQ ID NO: 43247 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgcttgtctgttgttaaaag

SEQ ID NO: 43248 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatatttgactatataaact

SEQ ID NO: 43249 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaattctataacttacctt

SEQ ID NO: 43250 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaattctataacttacctta

SEQ ID NO: 43251 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctataacttaccttaagga

SEQ ID NO: 43252 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctataacttaccttaaggaa

SEQ ID NO: 43253 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaggaaaggtaataaatact

SEQ ID NO: 43254 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atttgtctattccgtttgaa

SEQ ID NO: 43255 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtctattccgtttgaatag

SEQ ID NO: 43256 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctattccgtttgaatagcag

SEQ ID NO: 43257 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccgtttgaatagcagaagta

SEQ ID NO: 43258 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gcagaagtatggcatactgt

SEQ ID NO: 43259 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cagaagtatggcatactgtc

SEQ ID NO: 43260 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tattgtgcatctcttctttc

SEQ ID NO: 43261 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gtgcatctcttctttctgga

SEQ ID NO: 43262 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catctcttctttctggacgg

SEQ ID NO: 43263 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggacggtggtctattctctc

SEQ ID NO: 43264 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctctctggattattctctc

SEQ ID NO: 43265 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctggattattctctctgga

SEQ ID NO: 43266 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggattattctctctggacag

SEQ ID NO: 43267 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtagtaatatgctatactat

SEQ ID NO: 43268 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tagtaatatgctatactatt

SEQ ID NO: 43269 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tactgtgcaactcttctttc

SEQ ID NO: 43270 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caactcttctttctggatgc

SEQ ID NO: 43271 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggatgctggtctattctatc

SEQ ID NO: 43272 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctatctggcctattctatc

SEQ ID NO: 43273 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctggcctattctatctgga

SEQ ID NO: 43274 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggcctattctatctggatgg

SEQ ID NO: 43275 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctattctatctggatggtgg

SEQ ID NO: 43276 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggaagtatgtcacactgtt

SEQ ID NO: 43277 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctcttcttaactctgcatt

SEQ ID NO: 43278 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgcatttagcaatttcacat

SEQ ID NO: 43279 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atttagcaatttcacatcag

SEQ ID NO: 43280 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcacatcagtagtttgaaat

SEQ ID NO: 43281 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cagtagtttgaaatcagtga

SEQ ID NO: 43282 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagtttgaaatcagtgatgg

SEQ ID NO: 43283 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agtttgaaatcagtgatggt

SEQ ID NO: 43284 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttacattacaaaaatctcc

SEQ ID NO: 43285 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatctccaagcactacaaat

SEQ ID NO: 43286 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctccaagcactacaaatga

SEQ ID NO: 43287 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgagagcttcttgattttc

SEQ ID NO: 43288 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gagagcttcttgattttcta

SEQ ID NO: 43289 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agcttcttgattttctagag

SEQ ID NO: 43290 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgattttctagagtagaatt

SEQ ID NO: 43291 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttctagagtagaattaag

SEQ ID NO: 43292 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttctagagtagaattaaga

SEQ ID NO: 43293 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gagtagaattaagaaggtga

SEQ ID NO: 43294 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtagaattaagaaggtgatg

SEQ ID NO: 43295 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tagaattaagaaggtgatgg

SEQ ID NO: 43296 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tggaggaaatgccaataaaa

SEQ ID NO: 43297 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgccaataaaacagataaa

SEQ ID NO: 43298 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aataaaacagataaacagtc

SEQ ID NO: 43299 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ataaaacagataaacagtca

SEQ ID NO: 43300 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtcaaggtgtattgtgtttg

SEQ ID NO: 43301 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttgtagccattactctgaa

SEQ ID NO: 43302 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgcttacatcactgatgaat

SEQ ID NO: 43303 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acatcactgatgaatgagta

SEQ ID NO: 43304 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgagtaaagttctgacata

SEQ ID NO: 43305 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cactgactaacataaatatc

SEQ ID NO: 43306 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgactaacataaatatcaag

SEQ ID NO: 43307 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctaaaactatacttgtttat

SEQ ID NO: 43308 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgtttattagctgcaaaaa

SEQ ID NO: 43309 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtttattagctgcaaaaat

SEQ ID NO: 43310 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taggttgcctatacatgcaa

SEQ ID NO: 43311 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgcctatacatgcaaaagtt

SEQ ID NO: 43312 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atacatgcaaaagtttggca

SEQ ID NO: 43313 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agtttggcaaagttcaaaaa

SEQ ID NO: 43314 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gttcaaaaaaagcattcttt

SEQ ID NO: 43315 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgagaaacaatttgatata

SEQ ID NO: 43316 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatacagaatgttcaataaa

SEQ ID NO: 43317 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtgtcatatatcctaatat

SEQ ID NO: 43318 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cctaatatcagtaaaattta

SEQ ID NO: 43319 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatttatagtaaatgatat

SEQ ID NO: 43320 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tacacattttttattttcct

SEQ ID NO: 43321 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cacattttttattttccttg

SEQ ID NO: 43322 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttttattttccttggagaac

SEQ ID NO: 43323 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatatttacctacacatcac

SEQ ID NO: 43324 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atatttacctacacatcact

SEQ ID NO: 43325 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttacctacacatcactagga

SEQ ID NO: 43326 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tacctacacatcactaggac

SEQ ID NO: 43327 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctacacatcactaggacagg

SEQ ID NO: 43328 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acacatcactaggacaggta

SEQ ID NO: 43329 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cacatcactaggacaggtag

SEQ ID NO: 43330 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
catcactaggacaggtagag

SEQ ID NO: 43331 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggtagaggagaaaactttg

SEQ ID NO: 43332 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tagaggagaaaactttgaag

SEQ ID NO: 43333 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aactttgaagtagatgaaat

SEQ ID NO: 43334 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctttgaagtagatgaaatga

SEQ ID NO: 43335 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agatgaaatgagagatgaac

SEQ ID NO: 43336 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaaatgagagatgaacaag

SEQ ID NO: 43337 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaatgagagatgaacaaga

SEQ ID NO: 43338 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agagatgaacaagaaggacc

SEQ ID NO: 43339 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agatgaacaagaaggaccaa

SEQ ID NO: 43340 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gatgaacaagaaggaccaag

SEQ ID NO: 43341 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgaacaagaaggaccaaga

SEQ ID NO: 43342 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caagaaggaccaagagggtg

SEQ ID NO: 43343 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggaccaagagggtgcagtaa

SEQ ID NO: 43344 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
accaagagggtgcagtaaaa

SEQ ID NO: 43345 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgcagtaaaagagaaacca

SEQ ID NO: 43346 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcagtaaaagagaaaccaaa

SEQ ID NO: 43347 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagagaaaccaaagagtaaa

SEQ ID NO: 43348 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaagagtaaaaagttttat

SEQ ID NO: 43349 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agagtaaaaagttttataag

SEQ ID NO: 43350 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttttataagaagtgataaa

SEQ ID NO: 43351 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttataagaagtgataaaca

SEQ ID NO: 43352 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataaacagagctatgaacat

SEQ ID NO: 43353 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaacagagctatgaacataa

SEQ ID NO: 43354 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aacagagctatgaacataag

SEQ ID NO: 43355 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agctatgaacataagaggcc

SEQ ID NO: 43356 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgaacataagaggcccaga

SEQ ID NO: 43357 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaacataagaggcccagaaa

SEQ ID NO: 43358 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaaaattttaatcaattta

SEQ ID NO: 43359 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatcaatttaaagtttatta

SEQ ID NO: 43360 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttaaagtttattaaagcaac

SEQ ID NO: 43361 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagcaactagaattactctg

SEQ ID NO: 43362 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actagaattactctgaagaa

SEQ ID NO: 43363 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tagaattactctgaagaaaa

SEQ ID NO: 43364 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaattactctgaagaaaaga

SEQ ID NO: 43365 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaaagagagactctttaaa

SEQ ID NO: 43366 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gactctttaaaaagtaacta

SEQ ID NO: 43367 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aattcttcctcataaaattt

SEQ ID NO: 43368 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttagatgaaaaacctcattt

SEQ ID NO: 43369 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaaaacctcattttagatg

SEQ ID NO: 43370 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaaacctcattttagatga

SEQ ID NO: 43371 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacctcattttagatgaagg

SEQ ID NO: 43372 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acctcattttagatgaaggc

SEQ ID NO: 43373 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctcattttagatgaaggcag

SEQ ID NO: 43374 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcattttagatgaaggcagg

SEQ ID NO: 43375 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttttagatgaaggcaggagg

SEQ ID NO: 43376 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttagatgaaggcaggaggt

SEQ ID NO: 43377 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatgaaggcaggaggtggga

SEQ ID NO: 43378 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaggcaggaggtgggaaagt

SEQ ID NO: 43379 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aggaggtgggaaagtaagaa

SEQ ID NO: 43380 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggaggtgggaaagtaagaat

SEQ ID NO: 43381 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggtgggaaagtaagaatggg

SEQ ID NO: 43382 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cacttttttgatacctgttt

SEQ ID NO: 43383 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttttgatacctgtttcag

SEQ ID NO: 43384 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtttcagaagtttgaattt

SEQ ID NO: 43385 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaattttagatatttctaa

SEQ ID NO: 43386 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaacaatataattcattaac

SEQ ID NO: 43387 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ataattcattaacaagtatt

SEQ ID NO: 43388 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaacaagtattgagttttc

SEQ ID NO: 43389 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagttttcaagtaacaactt

SEQ ID NO: 43390 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taacaacttcagataatcat

SEQ ID NO: 43391 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgttctaaaacaacaaaac

SEQ ID NO: 43392 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaactagaatcctcttgac

SEQ ID NO: 43393 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcctcttgacaagatgcacc

SEQ ID NO: 43394 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcttgacaagatgcacctgg

SEQ ID NO: 43395 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaatcttttcatgtttctg

SEQ ID NO: 43396 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcatgtttctgaagtctaat

SEQ ID NO: 43397 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtctaattagtgcattgatc

SEQ ID NO: 43398 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcattgatccagttgatat

SEQ ID NO: 43399 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcattgatccagttgatata

SEQ ID NO: 43400 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttgatataaggttattttc

SEQ ID NO: 43401 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttttctagcactttaatttc

SEQ ID NO: 43402 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cactttaatttccagctcta

SEQ ID NO: 43403 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttccagctctatagaaata

SEQ ID NO: 43404 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctatagaaatacagcaaac

SEQ ID NO: 43405 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctatagaaatacagcaaaca

SEQ ID NO: 43406 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tccctctccccctatgtctc

SEQ ID NO: 43407 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtgttcctgttttttctctc

SEQ ID NO: 43408 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcctgttttttctctctgg

SEQ ID NO: 43409 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttctctctggaagtttct

SEQ ID NO: 43410 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctggaagtttctaagttcc

SEQ ID NO: 43411 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggaagtttctaagttcccag

SEQ ID NO: 43412 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gttcccagaagactcaaact

SEQ ID NO: 43413 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgcttgctctttgtgctta

SEQ ID NO: 43414 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtgcttatagtactcatca

SEQ ID NO: 43415 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
actcatcatagtcctctact

SEQ ID NO: 43416 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tagtcctctacttggcttaa

SEQ ID NO: 43417 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtcctctacttggcttaat

SEQ ID NO: 43418 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttggcttaataggtcattta

SEQ ID NO: 43419 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catttatagttgatttttaa

SEQ ID NO: 43420 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaagacttgattccccaaa

SEQ ID NO: 43421 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagacttgattccccaaaaa

SEQ ID NO: 43422 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagagttatataatcttct

SEQ ID NO: 43423 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagttatataatcttctaag

SEQ ID NO: 43424 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatataatcttctaagcagt

SEQ ID NO: 43425 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcagttagtcataatttga

SEQ ID NO: 43426 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcagttagtcataatttgaa

SEQ ID NO: 43427 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctatactttacataaacat

SEQ ID NO: 43428 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacataaacattggatgaaa

SEQ ID NO: 43429 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttggatgaaaaagaaaaaaa

SEQ ID NO: 43430 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggatgaaaaagaaaaaaaa

SEQ ID NO: 43431 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaagaaaaaaaaaggtgaa

SEQ ID NO: 43432 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtgaatggaaaatctacaca

SEQ ID NO: 43433 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catttatacaatgttaatta

SEQ ID NO: 43434 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aattacagtgaacatgatct

SEQ ID NO: 43435 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aattattatctacatgcatt

SEQ ID NO: 43436 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatctacatgcatttagtt

SEQ ID NO: 43437 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atctacatgcatttagttaa

SEQ ID NO: 43438 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctacatgcatttagttaaga

SEQ ID NO: 43439 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcgataaaatgatataaaaa

SEQ ID NO: 43440 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gataaaatgatataaaaaca

SEQ ID NO: 43441 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgatataaaaacagagtaa

SEQ ID NO: 43442 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgatataaaaacagagtaaa

SEQ ID NO: 43443 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gatataaaaacagagtaaaa

SEQ ID NO: 43444 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ataaaaacagagtaaaaggg

SEQ ID NO: 43445 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taaaaacagagtaaaagggt

SEQ ID NO: 43446 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaaacagagtaaaagggta

SEQ ID NO: 43447 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagggtcaaaaattaactct

SEQ ID NO: 43448 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aactctaagttaatcttttt

SEQ ID NO: 43449 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actctaagttaatctttttc

SEQ ID NO: 43450 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctctaagttaatctttttca

SEQ ID NO: 43451 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcagggaaaataaaaatac

SEQ ID NO: 43452 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagggaaaataaaaatacca

SEQ ID NO: 43453 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gggaaaataaaaataccaga

SEQ ID NO: 43454 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaaaataaaaataccagaga

SEQ ID NO: 43455 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccagagagagcgaaaaaaat

SEQ ID NO: 43456 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgaattttttaatattaact

SEQ ID NO: 43457 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttaatattaacttagtgctt

SEQ ID NO: 43458 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaaacaatgatcacatat

SEQ ID NO: 43459 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacaatgatcacatataaga

SEQ ID NO: 43460 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagaaagaatttatctttct

SEQ ID NO: 43461 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agaaagaatttatctttctc

SEQ ID NO: 43462 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaaagaatttatctttctca

SEQ ID NO: 43463 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaagaatttatctttctcag

SEQ ID NO: 43464 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctttctcaggggcaaattat

SEQ ID NO: 43465 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcaggggcaaattattggat

SEQ ID NO: 43466 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggataagaaaattatccctt

SEQ ID NO: 43467 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaaaattatccctttggtt

SEQ ID NO: 43468 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaattatccctttggttaag

SEQ ID NO: 43469 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gttaagaagattttgctctc

SEQ ID NO: 43470 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttaagaagattttgctctct

SEQ ID NO: 43471 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttgtcaatcttaaaattg

SEQ ID NO: 43472 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttgtcaatcttaaaattga

SEQ ID NO: 43473 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttgtcaatcttaaaattgaa

SEQ ID NO: 43474 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaaacattattcttatgatt

SEQ ID NO: 43475 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaacattattcttatgattg

SEQ ID NO: 43476 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaacactaaaaatcctaat

SEQ ID NO: 43477 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actaaaaatcctaattagaa

SEQ ID NO: 43478 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaatcctaattagaaaagt

SEQ ID NO: 43479 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaactttcaatctgaaatg

SEQ ID NO: 43480 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtttcataaatattgccct

SEQ ID NO: 43481 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtttcataaatattgccctc

SEQ ID NO: 43482 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttcataaatattgccctca

SEQ ID NO: 43483 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cctcagggtttattacacct

SEQ ID NO: 43484 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcagggtttattacacctca

SEQ ID NO: 43485 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agggtttattacacctcaga

SEQ ID NO: 43486 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gagtttctttctcttatttt

SEQ ID NO: 43487 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtttctttctcttattttg

SEQ ID NO: 43488 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctttctcttattttgaggc

SEQ ID NO: 43489 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttctcttattttgaggcaa

SEQ ID NO: 43490 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttattttgaggcaagagtga

SEQ ID NO: 43491 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attttgaggcaagagtgatg

SEQ ID NO: 43492 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agagtgatggagcgcctgtc

SEQ ID NO: 43493 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcctgtctggtttttgtgca

SEQ ID NO: 43494 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cctgtctggtttttgtgcaa

SEQ ID NO: 43495 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttgtgcaaaggtatatccc

SEQ ID NO: 43496 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtgcaaaggtatatcccaa

SEQ ID NO: 43497 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atcccaagagatttccaact

SEQ ID NO: 43498 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caagagatttccaactaagc

SEQ ID NO: 43499 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agatttccaactaagctggt

SEQ ID NO: 43500 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatcataccttctctttaa

SEQ ID NO: 43501 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatcataccttctctttaaa

SEQ ID NO: 43502 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttaattgaatgtaaacataa

SEQ ID NO: 43503 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aattgaatgtaaacataaca

SEQ ID NO: 43504 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaatctctcaaacattttaa

SEQ ID NO: 43505 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aatctctcaaacattttaat

SEQ ID NO: 43506 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcaaacattttaatgggtcc

SEQ ID NO: 43507 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acattttaatgggtcccagt

SEQ ID NO: 43508 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgagtaaatgctatttcttt

SEQ ID NO: 43509 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gagtaaatgctatttctttt

SEQ ID NO: 43510 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taaatgctatttcttttggg

SEQ ID NO: 43511 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtttcactaatgtgctctca

SEQ ID NO: 43512 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctctcatggtgcattacata

SEQ ID NO: 43513 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cattacataaagtctatgct

SEQ ID NO: 43514 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agtttcatcatgttaaacca

SEQ ID NO: 43515 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaaaaaaaaaaaaaaaaa

SEQ ID NO: 43516 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaaaaaaaaaaaaaaaaaa

SEQ ID NO: 43517 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaaaaaaaaaaaaaagga

SEQ ID NO: 43518 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaaaaaaaaaaaaaaggaa

SEQ ID NO: 43519 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaaaaaaaaaggaaagga

SEQ ID NO: 43520 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaaggaaaggaaagaaaa

SEQ ID NO: 43521 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaaccactgaccacttcaa

SEQ ID NO: 43522 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccactgaccacttcaaaaga

SEQ ID NO: 43523 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctattcattaaaaaccataa

SEQ ID NO: 43524 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaaattgattatgaaaac

SEQ ID NO: 43525 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgttaacattatctttccaa

SEQ ID NO: 43526 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacattatctttccaaaaga

SEQ ID NO: 43527 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccaaaagaaagaaaaaataa

SEQ ID NO: 43528 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagaaaaaataaaagtcaca

SEQ ID NO: 43529 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agaaaaaataaaagtcacaa

SEQ ID NO: 43530 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaaaataaaagtcacaaag

SEQ ID NO: 43531 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aataaaagtcacaaaggagt

SEQ ID NO: 43532 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agttggttattgtgttacta

SEQ ID NO: 43533 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggttattgtgttactaaagt

SEQ ID NO: 43534 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctaaagttagaattaattat

SEQ ID NO: 43535 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attaattattagttatttta

SEQ ID NO: 43536 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttaattattagttattttat

SEQ ID NO: 43537 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attattagttattttatagg

SEQ ID NO: 43538 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttattagttattttatagga

SEQ ID NO: 43539 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tattagttattttataggaa

SEQ ID NO: 43540 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
attagttattttataggaag

SEQ ID NO: 43541 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttagttattttataggaagg

SEQ ID NO: 43542 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgaatacaaaacattttga

SEQ ID NO: 43543 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgaatacaaaacattttgaa

SEQ ID NO: 43544 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atacaaaacattttgaaagg

SEQ ID NO: 43545 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attttgaaaggaagatgatt

SEQ ID NO: 43546 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgatttggcttctcctacc

SEQ ID NO: 43547 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggcttctcctaccaagttaa

SEQ ID NO: 43548 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tattaccattattatttttt

SEQ ID NO: 43549 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
accattattattttttgaga

SEQ ID NO: 43550 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cattattattttttgagaca

SEQ ID NO: 43551 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acagagtctcactttgttgc

SEQ ID NO: 43552 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagagtctcactttgttgcc

SEQ ID NO: 43553 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtctcactttgttgccaggc

SEQ ID NO: 43554 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctcactttgttgccaggctg

SEQ ID NO: 43555 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttgttgccaggctggagtg

SEQ ID NO: 43556 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttgccaggctggagtgcag

SEQ ID NO: 43557 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gccaggctggagtgcagtag

SEQ ID NO: 43558 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccaggctggagtgcagtagc

SEQ ID NO: 43559 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggagtgcagtagcaggatct

SEQ ID NO: 43560 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcactgcaacctctgcctcc

SEQ ID NO: 43561 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cactgcaacctctgcctcct

SEQ ID NO: 43562 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacctctgcctcctgggttc

SEQ ID NO: 43563 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcaagcgattctcctgcct

SEQ ID NO: 43564 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttctcctgcctcagcctctt

SEQ ID NO: 43565 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcctgcctcagcctcttgag

SEQ ID NO: 43566 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcctcagcctcttgagtagc

SEQ ID NO: 43567 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctcagcctcttgagtagct

SEQ ID NO: 43568 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcttgagtagctgggacta

SEQ ID NO: 43569 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcttgagtagctgggactac

SEQ ID NO: 43570 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggactacaggcgctcaccac

SEQ ID NO: 43571 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gactacaggcgctcaccacc

SEQ ID NO: 43572 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caggcgctcaccaccaggct

SEQ ID NO: 43573 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcagctaatttttgtatttt

SEQ ID NO: 43574 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gctaatttttgtatttttag

SEQ ID NO: 43575 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ttttgtatttttagtagaaa

SEQ ID NO: 43576 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttgtatttttagtagaaac

SEQ ID NO: 43577 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaaacgggatttcaccatgt

SEQ ID NO: 43578 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cgggatttcaccatgttagc

SEQ ID NO: 43579 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gggatttcaccatgttagcc

SEQ ID NO: 43580 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttcaccatgttagccagga

SEQ ID NO: 43581 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatctcttgaccttgtgaaa

SEQ ID NO: 43582 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atctcttgaccttgtgaaaa

SEQ ID NO: 43583 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttactaatttgataatctaa

SEQ ID NO: 43584 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctaatttgataatctaaaag

SEQ ID NO: 43585 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagcacaatataaaaccaca

SEQ ID NO: 43586 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tataaaaccacatagaccca

SEQ ID NO: 43587 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taaaaccacatagacccaaa

SEQ ID NO: 43588 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgtcatgttcataattata

SEQ ID NO: 43589 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtcatgttcataattatat

SEQ ID NO: 43590 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcataattatataggttgcc

SEQ ID NO: 43591 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atataggttgccaagtcatg

SEQ ID NO: 43592 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgccaagtcatgtagaact

SEQ ID NO: 43593 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgccaagtcatgtagaacta

SEQ ID NO: 43594 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagtcatgtagaactaagga

SEQ ID NO: 43595 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgtagaactaaggatagta

SEQ ID NO: 43596 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaactaaggatagtaaagaa

SEQ ID NO: 43597 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aactaaggatagtaaagaac

SEQ ID NO: 43598 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
actaaggatagtaaagaaca

SEQ ID NO: 43599 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggatagtaaagaacagggc

SEQ ID NO: 43600 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aaagaacagggcaagatata

SEQ ID NO: 43601 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaacagggcaagatatacgg

SEQ ID NO: 43602 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagggcaagatatacggaag

SEQ ID NO: 43603 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agatatacggaagcagtctg

SEQ ID NO: 43604 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtctgaagtcttcaaataca

SEQ ID NO: 43605 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtcttcaaatacaaagtaa

SEQ ID NO: 43606 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caaatacaaagtaatagaca

SEQ ID NO: 43607 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatacaaagtaatagacaca

SEQ ID NO: 43608 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagtaatagacacagagct

SEQ ID NO: 43609 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagtaatagacacagagcta

SEQ ID NO: 43610 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gctaaggaacaaccttgcat

SEQ ID NO: 43611 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taaggaacaaccttgcataa

SEQ ID NO: 43612 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaggaacaaccttgcataag

SEQ ID NO: 43613 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aggaacaaccttgcataaga

SEQ ID NO: 43614 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaacaaccttgcataagagg

SEQ ID NO: 43615 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acaaccttgcataagaggga

SEQ ID NO: 43616 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttgcataagagggagagaa

SEQ ID NO: 43617 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgcataagagggagagaaa

SEQ ID NO: 43618 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagggagagaaaaggtgaat

SEQ ID NO: 43619 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gggagagaaaaggtgaataa

SEQ ID NO: 43620 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggagagaaaaggtgaataag

SEQ ID NO: 43621 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaaggtgaataagaggaac

SEQ ID NO: 43622 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgcaatcaatgaaatacat

SEQ ID NO: 43623 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atcaatgaaatacattagta

SEQ ID NO: 43624 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttagtaaagtgataattatg

SEQ ID NO: 43625 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgaaatgaatcaacaaatgt

SEQ ID NO: 43626 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atcgttttaacatttatctt

SEQ ID NO: 43627 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcagtaaaaacatgctact

SEQ ID NO: 43628 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taattttttctgttaccttt

SEQ ID NO: 43629 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aattttttctgttacctttc

SEQ ID NO: 43630 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttttctgttacctttcagg

SEQ ID NO: 43631 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttctgttacctttcaggtag

SEQ ID NO: 43632 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgttacctttcaggtagca

SEQ ID NO: 43633 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttcaggtagcagagatctc

SEQ ID NO: 43634 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcaggtagcagagatctctg

SEQ ID NO: 43635 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caggtagcagagatctctgg

SEQ ID NO: 43636 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggtgaaacattgctctgaac

SEQ ID NO: 43637 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctctgaactggcattgattc

SEQ ID NO: 43638 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aactggcattgattctagcc

SEQ ID NO: 43639 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgattctagcccagctcttg

SEQ ID NO: 43640 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagaccaattaccaacttgt

SEQ ID NO: 43641 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcatgattcttcattctgac

SEQ ID NO: 43642 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctgacaagcccatgcttct

SEQ ID NO: 43643 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catgcttctcagtcttcatg

SEQ ID NO: 43644 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgtggaaactatgcatttc

SEQ ID NO: 43645 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actatgcatttccagttttt

SEQ ID NO: 43646 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatccatcaacaaatccctt

SEQ ID NO: 43647 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctctaacttcaaaatatact

SEQ ID NO: 43648 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatacaaaactctaccatac

SEQ ID NO: 43649 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaactctaccatactagtct

SEQ ID NO: 43650 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agctcccatcacctctcacc

SEQ ID NO: 43651 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acctctcacctggatttatg

SEQ ID NO: 43652 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggatttatgcagaaactcc

SEQ ID NO: 43653 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaaactccaagaaatcttc

SEQ ID NO: 43654 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctattcgcccttccactctt

SEQ ID NO: 43655 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctcttaagattgcacattgt

SEQ ID NO: 43656 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcttcaaatgtcttataatc

SEQ ID NO: 43657 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgttttatttgtttgtttgt

SEQ ID NO: 43658 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttttatttgtttgtttgttg

SEQ ID NO: 43659 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atttgtttgtttgttggaga

SEQ ID NO: 43660 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgtttgtttgttggagaca

SEQ ID NO: 43661 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagagtcttcctctgtcgtc

SEQ ID NO: 43662 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agagtcttcctctgtcgtcc

SEQ ID NO: 43663 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcttcctctgtcgtccaggc

SEQ ID NO: 43664 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttcctctgtcgtccaggctg

SEQ ID NO: 43665 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgtcgtccaggctggagtg

SEQ ID NO: 43666 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcgtccaggctggagtgcag

SEQ ID NO: 43667 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggagtgcagtggcacaatct

SEQ ID NO: 43668 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcactgcaacctctgcctcc

SEQ ID NO: 43669 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacctctgcctcctggattc

SEQ ID NO: 43670 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcaagtaattctcgtgcct

SEQ ID NO: 43671 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttctcgtgcctcagcctcac

SEQ ID NO: 43672 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcgtgcctcagcctcacaag

SEQ ID NO: 43673 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcctcagcctcacaagtagc

SEQ ID NO: 43674 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctcagcctcacaagtagct

SEQ ID NO: 43675 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctcacaagtagctgggatta

SEQ ID NO: 43676 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcacaagtagctgggattat

SEQ ID NO: 43677 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gattataggcatgtatcacc

SEQ ID NO: 43678 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attaatttttttttcatttt

SEQ ID NO: 43679 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttttcattttcagtaaaaa

SEQ ID NO: 43680 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttttcattttcagtaaaaat

SEQ ID NO: 43681 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttcattttcagtaaaaatg

SEQ ID NO: 43682 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaatggggtttcgctacgt

SEQ ID NO: 43683 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tggggtttcgctacgttggc

SEQ ID NO: 43684 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggggtttcgctacgttggcc

SEQ ID NO: 43685 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttcgctacgttggccaggc

SEQ ID NO: 43686 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccaggctggtcttgaactcc

SEQ ID NO: 43687 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggtcttgaactcctggcctc

SEQ ID NO: 43688 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
cctcaagtgatcgcccacct

SEQ ID NO: 43689 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcgcccacctcggcctccca

SEQ ID NO: 43690 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acctcggcctcccaaagtac

SEQ ID NO: 43691 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctcccaaagtactggaatta

SEQ ID NO: 43692 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcccaaagtactggaattat

SEQ ID NO: 43693 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtactggaattataggtgt

SEQ ID NO: 43694 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taggtgtgagccacttcacc

SEQ ID NO: 43695 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcattattctccatctattt

SEQ ID NO: 43696 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctccatctattttggcctct

SEQ ID NO: 43697 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgttatgcatatcctcacct

SEQ ID NO: 43698 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gttatgcatatcctcacctt

SEQ ID NO: 43699 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttatgcatatcctcaccttg

SEQ ID NO: 43700 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tttccctccatatatttgca

SEQ ID NO: 43701 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
cttcaattttctttacatca

SEQ ID NO: 43702 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caattttctttacatcacgg

SEQ ID NO: 43703 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cggaagaaacgccaccttta

SEQ ID NO: 43704 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggaagaaacgccacctttat

SEQ ID NO: 43705 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaaacgccacctttatagg

SEQ ID NO: 43706 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaacgccacctttataggc

SEQ ID NO: 43707 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctgaccaatcattcattga

SEQ ID NO: 43708 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgatagcatatttatgtgc

SEQ ID NO: 43709 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagcatatttatgtgctagt

SEQ ID NO: 43710 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagttcttccccctcactct

SEQ ID NO: 43711 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttccatataccttctcca

SEQ ID NO: 43712 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tacatcttgatatgtttctt

SEQ ID NO: 43713 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcttgatatgtttcttcagc

SEQ ID NO: 43714 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttgatatgtttcttcagca

SEQ ID NO: 43715 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttgatatgtttcttcagcaa

SEQ ID NO: 43716 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgatatgtttcttcagcaag

SEQ ID NO: 43717 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaggggtattgttttgttca

SEQ ID NO: 43718 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcacagctccatctccctc

SEQ ID NO: 43719 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctccatctccctccagtgcc

SEQ ID NO: 43720 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctccctccagtgcctggaac

SEQ ID NO: 43721 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccagtgcctggaactggacc

SEQ ID NO: 43722 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctggaactggacctggcaca

SEQ ID NO: 43723 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggaactggacctggcacac

SEQ ID NO: 43724 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttaataattatttgtttac

SEQ ID NO: 43725 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attatttgtttactggaata

SEQ ID NO: 43726 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
agaatgattatgtgaataca

SEQ ID NO: 43727 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatgtgaatacacggttga

SEQ ID NO: 43728 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatgtgaatacacggttgaa

SEQ ID NO: 43729 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaatacacggttgaaaggct

SEQ ID NO: 43730 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggttgaaaggctaagcaaat

SEQ ID NO: 43731 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggctgcttcactgaatttat

SEQ ID NO: 43732 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gctgcttcactgaatttatt

SEQ ID NO: 43733 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcactgaatttattaggcta

SEQ ID NO: 43734 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatttattaggctacagatc

SEQ ID NO: 43735 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttattaggctacagatcca

SEQ ID NO: 43736 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acagatccagagactgtatg

SEQ ID NO: 43737 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agactgtatgaagtctctgc

SEQ ID NO: 43738 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
actgtatgaagtctctgctg

SEQ ID NO: 43739 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtctctgctggagcacataa

SEQ ID NO: 43740 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctctgctggagcacataaa

SEQ ID NO: 43741 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctctgctggagcacataaaa

SEQ ID NO: 43742 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cacataaaagggatgtgact

SEQ ID NO: 43743 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cataaaagggatgtgactca

SEQ ID NO: 43744 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcagagatatatgctccct

SEQ ID NO: 43745 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gctccctcagtaaatttcaa

SEQ ID NO: 43746 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcagtaaatttcaatggtcc

SEQ ID NO: 43747 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaatttcaatggtccaagcc

SEQ ID NO: 43748 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatttcaatggtccaagccc

SEQ ID NO: 43749 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggtccaagcccaggttcat

SEQ ID NO: 43750 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccataatatttcttctatac

SEQ ID NO: 43751 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatttcttctatactggcct

SEQ ID NO: 43752 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cttctatactggcctcagtt

SEQ ID NO: 43753 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctatactggcctcagtttgg

SEQ ID NO: 43754 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttggaagcaatgaataatct

SEQ ID NO: 43755 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggaagcaatgaataatctca

SEQ ID NO: 43756 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taatctcagagtattcacaa

SEQ ID NO: 43757 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtattttcattgatgttta

SEQ ID NO: 43758 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtattttcattgatgtttat

SEQ ID NO: 43759 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtattatatcttattataa

SEQ ID NO: 43760 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcttattataacagcaccta

SEQ ID NO: 43761 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acagcacctacagtctgaaa

SEQ ID NO: 43762 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acctacagtctgaaatagca

SEQ ID NO: 43763 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atagtattaatactttctgt

SEQ ID NO: 43764 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtattaatactttctgtaa

SEQ ID NO: 43765 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatactttctgtaagagttt

SEQ ID NO: 43766 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtaagagtttaagttttttg

SEQ ID NO: 43767 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agttttttgaagtcattttt

SEQ ID NO: 43768 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attttttggtttgaaacttt

SEQ ID NO: 43769 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaactttaagttgattgat

SEQ ID NO: 43770 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgataagcccaacttctttc

SEQ ID NO: 43771 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caacttctttctagttatcc

SEQ ID NO: 43772 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctagttatcctagaatttt

SEQ ID NO: 43773 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgatcattcataaaatgaa

SEQ ID NO: 43774 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgatcattcataaaatgaat

SEQ ID NO: 43775 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gatcattcataaaatgaata

SEQ ID NO: 43776 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaatgaatagggaaaatct

SEQ ID NO: 43777 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgaatagggaaaatcttgg

SEQ ID NO: 43778 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggtagcatcaatacaaattt

SEQ ID NO: 43779 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atactgctaataaatttctt

SEQ ID NO: 43780 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tactgctaataaatttcttg

SEQ ID NO: 43781 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgctaataaatttcttgag

SEQ ID NO: 43782 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctaataaatttcttgaggag

SEQ ID NO: 43783 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taataaatttcttgaggagc

SEQ ID NO: 43784 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attcttaaatctctgtaaca

SEQ ID NO: 43785 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgtaacatggacactttta

SEQ ID NO: 43786 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtaacatggacacttttaa

SEQ ID NO: 43787 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggaaactgtgcatttgctta

SEQ ID NO: 43788 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttgcttatagcactaattt

SEQ ID NO: 43789 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttatagcactaatttcagc

SEQ ID NO: 43790 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agcacaaaatttatattgac

SEQ ID NO: 43791 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcttacataaaatgatatt

SEQ ID NO: 43792 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgatatttggtgtgtattta

SEQ ID NO: 43793 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaaaatccatgcactctttg

SEQ ID NO: 43794 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcttaacccatgaatgttat

SEQ ID NO: 43795 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccatgaatgttataagaaac

SEQ ID NO: 43796 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatgttataagaaaccagtt

SEQ ID NO: 43797 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaaaccagttgagaaaatct

SEQ ID NO: 43798 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagaaaatcttggacactga

SEQ ID NO: 43799 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatcttggacactgaaagc

SEQ ID NO: 43800 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttcaaaaaatactaatgct

SEQ ID NO: 43801 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttcaaaaaatactaatgctg

SEQ ID NO: 43802 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcaaaaaatactaatgctga

SEQ ID NO: 43803 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaatactaatgctgagggt

SEQ ID NO: 43804 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gctgagggtaagcccatgac

SEQ ID NO: 43805 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gggtaagcccatgactagat

SEQ ID NO: 43806 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cccatgactagataagtcat

SEQ ID NO: 43807 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgctatcataacttctgtat

SEQ ID NO: 43808 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttctgtataagattgttaa

SEQ ID NO: 43809 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gattgttaacagaatccttg

SEQ ID NO: 43810 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taacagaatccttgaagaat

SEQ ID NO: 43811 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaatccttgaagaataagaa

SEQ ID NO: 43812 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tccttgaagaataagaaaag

SEQ ID NO: 43813 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgaagaataagaaaagtag

SEQ ID NO: 43814 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagaataagaaaagtagaag

SEQ ID NO: 43815 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agaataagaaaagtagaaga

SEQ ID NO: 43816 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataagaaaagtagaagaagg

SEQ ID NO: 43817 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaaaagtagaagaaggaaga

SEQ ID NO: 43818 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaagtagaagaaggaagat

SEQ ID NO: 43819 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaggaagataggcactgtgc

SEQ ID NO: 43820 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagataggcactgtgctagt

SEQ ID NO: 43821 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attatcttatttgatcctct

SEQ ID NO: 43822 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctcttagcatcgctgtgatg

SEQ ID NO: 43823 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgctgatatccccatttta

SEQ ID NO: 43824 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gatatccccattttacagat

SEQ ID NO: 43825 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttacagatgagatatctg

SEQ ID NO: 43826 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agatgagatatctgaagaac

SEQ ID NO: 43827 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caagattttaaattgtgcac

SEQ ID NO: 43828 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaattgtgcacaagttctca

SEQ ID NO: 43829 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aattgtgcacaagttctcac

SEQ ID NO: 43830 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtgcacaagttctcacagg

SEQ ID NO: 43831 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acaagttctcacaggcagat

SEQ ID NO: 43832 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gttctcacaggcagataagt

SEQ ID NO: 43833 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aggcagataagtcggcaaat

SEQ ID NO: 43834 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaattagaacatatgtttat

SEQ ID NO: 43835 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aattagaacatatgtttatc

SEQ ID NO: 43836 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catatgtttatcaggctcca

SEQ ID NO: 43837 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtattactgtattacattg

SEQ ID NO: 43838 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attacattgcagccctactc

SEQ ID NO: 43839 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttacattgcagccctactct

SEQ ID NO: 43840 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctgggcttgtatttttacc

SEQ ID NO: 43841 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tagatgatacaatacttgtt

SEQ ID NO: 43842 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcattatccctgacaaattc

SEQ ID NO: 43843 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatccctgacaaattccag

SEQ ID NO: 43844 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tccctgacaaattccagaag

SEQ ID NO: 43845 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgacaaattccagaagtagt

SEQ ID NO: 43846 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tccagaagtagtaagaaatt

SEQ ID NO: 43847 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tagtaagaaattcagcatat

SEQ ID NO: 43848 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagaaattcagcatatcaga

SEQ ID NO: 43849 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcagcatatcagaaagcata

SEQ ID NO: 43850 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagcatatcagaaagcatac

SEQ ID NO: 43851 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcatatcagaaagcatacag

SEQ ID NO: 43852 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatcagaaagcatacaggag

SEQ ID NO: 43853 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagaaagcatacaggagtag

SEQ ID NO: 43854 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agaaagcatacaggagtaga

SEQ ID NO: 43855 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaagcatacaggagtagaag

SEQ ID NO: 43856 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagcatacaggagtagaagg

SEQ ID NO: 43857 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggaggtactgttacaaaac

SEQ ID NO: 43858 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaggtactgttacaaaacaa

SEQ ID NO: 43859 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgttacaaaacaagagact

SEQ ID NO: 43860 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgttacaaaacaagagacta

SEQ ID NO: 43861 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agagactaaggccaaatgta

SEQ ID NO: 43862 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtaaagaactttacatgtc

SEQ ID NO: 43863 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaactttacatgtcaagtt

SEQ ID NO: 43864 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaactttacatgtcaagtta

SEQ ID NO: 43865 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acatgtcaagttaaggactt

SEQ ID NO: 43866 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaggacttcagactttaccc

SEQ ID NO: 43867 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggacttcagactttacccta

SEQ ID NO: 43868 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gacttcagactttaccctag

SEQ ID NO: 43869 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagactttaccctagaggcc

SEQ ID NO: 43870 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agactttaccctagaggcca

SEQ ID NO: 43871 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggccaaggattctcacattt

SEQ ID NO: 43872 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgtgcatgcaaatcctctt

SEQ ID NO: 43873 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtgcatgcaaatcctctta

SEQ ID NO: 43874 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtgcatgcaaatcctcttaa

SEQ ID NO: 43875 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgcaaatcctcttaagggct

SEQ ID NO: 43876 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcaaatcctcttaagggctt

SEQ ID NO: 43877 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagggcttgggccctatctc

SEQ ID NO: 43878 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gggcttgggccctatctcca

SEQ ID NO: 43879 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttcctgatgaacttgtgac

SEQ ID NO: 43880 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgatgaacttgtgactagc

SEQ ID NO: 43881 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgatgaacttgtgactagca

SEQ ID NO: 43882 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgactagcaaggaaaacttt

SEQ ID NO: 43883 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gactagcaaggaaaacttta

SEQ ID NO: 43884 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
actagcaaggaaaactttaa

SEQ ID NO: 43885 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaactttaagggtctctca

SEQ ID NO: 43886 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taagggtctctcaaagtctt

SEQ ID NO: 43887 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctctcaaagtctttagctt

SEQ ID NO: 43888 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctctcaaagtctttagcttg

SEQ ID NO: 43889 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tctcaaagtctttagcttga

SEQ ID NO: 43890 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagtctttagcttgagggt

SEQ ID NO: 43891 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagtctttagcttgagggta

SEQ ID NO: 43892 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctttagcttgagggtaagg

SEQ ID NO: 43893 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgagggtaaggtagatcatg

SEQ ID NO: 43894 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agatcatgaagttactaata

SEQ ID NO: 43895 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgaagttactaataaagac

SEQ ID NO: 43896 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaagttactaataaagactg

SEQ ID NO: 43897 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagttactaataaagactgg

SEQ ID NO: 43898 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttactaataaagactggagg

SEQ ID NO: 43899 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggaagctgtaaaccatacta

SEQ ID NO: 43900 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaaaaaaacttattaaact

SEQ ID NO: 43901 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttggaatgttttacaaacaa

SEQ ID NO: 43902 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatgttttacaaacaacaga

SEQ ID NO: 43903 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caacagatggtgatgaccaa

SEQ ID NO: 43904 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aacagatggtgatgaccaat

SEQ ID NO: 43905 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acagatggtgatgaccaatg

SEQ ID NO: 43906 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatgaccaatggggaattgt

SEQ ID NO: 43907 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaccaatggggaattgtaag

SEQ ID NO: 43908 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggggaattgtaagcagatc

SEQ ID NO: 43909 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggggaattgtaagcagatct

SEQ ID NO: 43910 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtaagcagatctgggactc

SEQ ID NO: 43911 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taagcagatctgggactcaa

SEQ ID NO: 43912 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagatctgggactcaagagt

SEQ ID NO: 43913 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agatctgggactcaagagtg

SEQ ID NO: 43914 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgggactcaagagtgaggt

SEQ ID NO: 43915 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gggactcaagagtgaggtta

SEQ ID NO: 43916 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggactcaagagtgaggttag

SEQ ID NO: 43917 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caagagtgaggttagaggta

SEQ ID NO: 43918 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaggtaaagacattgatgtt

SEQ ID NO: 43919 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggtaaagacattgatgttaa

SEQ ID NO: 43920 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acattgatgttaagagtcaa

SEQ ID NO: 43921 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gatgttaagagtcaatagca

SEQ ID NO: 43922 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagagtcaatagcacagaaa

SEQ ID NO: 43923 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagcacagaaatggcttttc

SEQ ID NO: 43924 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaaatggcttttcaagcca

SEQ ID NO: 43925 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaatggcttttcaagccac

SEQ ID NO: 43926 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caggcatgcatgaaacacct

SEQ ID NO: 43927 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggcatgcatgaaacacctca

SEQ ID NO: 43928 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catgaaacacctcagagctt

SEQ ID NO: 43929 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acacctcagagcttcagaat

SEQ ID NO: 43930 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcagagcttcagaataagaa

SEQ ID NO: 43931 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaataagaaaagataactg

SEQ ID NO: 43932 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ataactgaagattgaacatg

SEQ ID NO: 43933 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taactgaagattgaacatgt

SEQ ID NO: 43934 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aactgaagattgaacatgtg

SEQ ID NO: 43935 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgaagattgaacatgtggg

SEQ ID NO: 43936 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tggggagaaatcattattta

SEQ ID NO: 43937 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggggagaaatcattatttac

SEQ ID NO: 43938 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atcattatttacaggatgtg

SEQ ID NO: 43939 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcagaaaaaatactcatta

SEQ ID NO: 43940 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaaatactcattaaagaaa

SEQ ID NO: 43941 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaatactcattaaagaaata

SEQ ID NO: 43942 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atactcattaaagaaataga

SEQ ID NO: 43943 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
actcattaaagaaatagaga

SEQ ID NO: 43944 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctcattaaagaaatagagag

SEQ ID NO: 43945 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagaaatagagagaggaact

SEQ ID NO: 43946 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agagaggaactcagaactct

SEQ ID NO: 43947 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagaactctaagacaaataa

SEQ ID NO: 43948 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctaagacaaataaaagacca

SEQ ID NO: 43949 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taagacaaataaaagaccaa

SEQ ID NO: 43950 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gacaaataaaagaccaaagg

SEQ ID NO: 43951 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaagaccaaaggtagacta

SEQ ID NO: 43952 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agactatggcctctgaaact

SEQ ID NO: 43953 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gactatggcctctgaaacta

SEQ ID NO: 43954 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atggcctctgaaactaagga

SEQ ID NO: 43955 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggcctctgaaactaaggaa

SEQ ID NO: 43956 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cctctgaaactaaggaaagg

SEQ ID NO: 43957 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctaaggaaaggaagaatttt

SEQ ID NO: 43958 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaggaaaggaagaattttga

SEQ ID NO: 43959 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggaaaggaagaattttgaga

SEQ ID NO: 43960 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagaattttgagagagactg

SEQ ID NO: 43961 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgagagagactgtagtcaa

SEQ ID NO: 43962 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgtagtcaacagtatcaaa

SEQ ID NO: 43963 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acagtatcaaacagttttct

SEQ ID NO: 43964 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtatcaaacagttttctga

SEQ ID NO: 43965 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcaaacagttttctgagagt

SEQ ID NO: 43966 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acagttttctgagagttagt

SEQ ID NO: 43967 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttttctgagagttagtgag

SEQ ID NO: 43968 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagattccatttttgattaa

SEQ ID NO: 43969 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agattccatttttgattaaa

SEQ ID NO: 43970 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccatttttgattaaaaggac

SEQ ID NO: 43971 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atttttgattaaaaggacca

SEQ ID NO: 43972 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgattaaaaggaccagagta

SEQ ID NO: 43973 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctttcattaacttgtattc

SEQ ID NO: 43974 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcattaacttgtattctgg

SEQ ID NO: 43975 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttctggtggttccattgatc

SEQ ID NO: 43976 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tctggtggttccattgatct

SEQ ID NO: 43977 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgatctgggaatacgaatt

SEQ ID NO: 43978 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgatctgggaatacgaatta

SEQ ID NO: 43979 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acgaattaaggctctaaaat

SEQ ID NO: 43980 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattaaggctctaaaataag

SEQ ID NO: 43981 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaggctctaaaataagaag

SEQ ID NO: 43982 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggctctaaaataagaagtag

SEQ ID NO: 43983 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagaagtagtagcatgctta

SEQ ID NO: 43984 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catgcttacagtctaacata

SEQ ID NO: 43985 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacagtctaacatacagtga

SEQ ID NO: 43986 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acagtctaacatacagtgat

SEQ ID NO: 43987 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagtgataggaaattactgt

SEQ ID NO: 43988 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataggaaattactgttagtc

SEQ ID NO: 43989 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttactgttagtcaagtgcca

SEQ ID NO: 43990 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttagtcaagtgccatagatg

SEQ ID NO: 43991 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgccatagatgtggaaactc

SEQ ID NO: 43992 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tagatgtggaaactcaagct

SEQ ID NO: 43993 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gatgtggaaactcaagctta

SEQ ID NO: 43994 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtggaaactcaagcttaga

SEQ ID NO: 43995 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aactcaagcttagagagctc

SEQ ID NO: 43996 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acttgcccttaatcatcata

SEQ ID NO: 43997 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccttaatcatcatacagcta

SEQ ID NO: 43998 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcatacagctatagctgaat

SEQ ID NO: 43999 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cagctatagctgaatcagca

SEQ ID NO: 44000 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atagctgaatcagcatggaa

SEQ ID NO: 44001 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agctgaatcagcatggaatg

SEQ ID NO: 44002 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctgacttaccgacaacctc

SEQ ID NO: 44003 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acttaccgacaacctctggt

SEQ ID NO: 44004 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cgacaacctctggtaagtat

SEQ ID NO: 44005 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gacaacctctggtaagtatt

SEQ ID NO: 44006 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctggtaagtattaggcgtt

SEQ ID NO: 44007 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttaggcgttaagacaaaccc

SEQ ID NO: 44008 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaaccccagaacactaatt

SEQ ID NO: 44009 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaccccagaacactaatta

SEQ ID NO: 44010 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctaattaaggaatgctaacc

SEQ ID NO: 44011 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taattaaggaatgctaacca

SEQ ID NO: 44012 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgtcttaccatctgtgaaa

SEQ ID NO: 44013 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtcttaccatctgtgaaac

SEQ ID NO: 44014 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccatctgtgaaacaggcctc

SEQ ID NO: 44015 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gaaacaggcctctggctcat

SEQ ID NO: 44016 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctctggctcatcggaattca

SEQ ID NO: 44017 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctggctcatcggaattcat

SEQ ID NO: 44018 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcatcggaattcataggtt

SEQ ID NO: 44019 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctctgcttcttctccttctc

SEQ ID NO: 44020 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctgcttcttctccttctcc

SEQ ID NO: 44021 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcttctccttctccaggca

SEQ ID NO: 44022 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcttctccttctccaggcaa

SEQ ID NO: 44023 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cttctccttctccaggcaaa

SEQ ID NO: 44024 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatcaactgtgctgcactct

SEQ ID NO: 44025 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atcaactgtgctgcactctg

SEQ ID NO: 44026 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caactgtgctgcactctgag

SEQ ID NO: 44027 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tgcactctgaggagcttgac

SEQ ID NO: 44028 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agcttgaccggtttaatctc

SEQ ID NO: 44029 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaccggtttaatctctaga

SEQ ID NO: 44030 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaccggtttaatctctagaa

SEQ ID NO: 44031 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaggaattcaccaccccac

SEQ ID NO: 44032 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaggaattcaccaccccacc

SEQ ID NO: 44033 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaattcaccaccccaccagg

SEQ ID NO: 44034 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
accccaccaggtagttcatt

SEQ ID NO: 44035 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cccaccaggtagttcattta

SEQ ID NO: 44036 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcattcaaatatgatattt

SEQ ID NO: 44037 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttaagccttatttaataat

SEQ ID NO: 44038 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaataatcagactcatgca

SEQ ID NO: 44039 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catgcaaagtattatgaaaa

SEQ ID NO: 44040 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtattatgaaaaaagattaa

SEQ ID NO: 44041 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaaaagattaatagtatga

SEQ ID NO: 44042 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaatgtataaacacatatt

SEQ ID NO: 44043 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaatgtataaacacatattg

SEQ ID NO: 44044 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tataaacacatattgaggtc

SEQ ID NO: 44045 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attatgtttattatactaac

SEQ ID NO: 44046 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttattatactaacaagtacg

SEQ ID NO: 44047 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aacaagtacgtggccaaaat

SEQ ID NO: 44048 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtacgtggccaaaattagat

SEQ ID NO: 44049 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tacgtggccaaaattagata

SEQ ID NO: 44050 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgatgttaactatcacttt

SEQ ID NO: 44051 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgttaactatcacttttgga

SEQ ID NO: 44052 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaatttttaatataaattta

SEQ ID NO: 44053 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gacactgacaatcattattt

SEQ ID NO: 44054 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acactgacaatcattatttg

SEQ ID NO: 44055 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccctatttgcaatataatac

SEQ ID NO: 44056 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tactaatgcctgatcattga

SEQ ID NO: 44057 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgcctgatcattgaaagct

SEQ ID NO: 44058 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cattgaaagctcagatcaaa

SEQ ID NO: 44059 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaaagctcagatcaaatagt

SEQ ID NO: 44060 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttggcaaaaaacttattga

SEQ ID NO: 44061 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatagttaaaattttttaaa

SEQ ID NO: 44062 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaaaattttttaaaaagat

SEQ ID NO: 44063 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttttaaaaagataagtgc

SEQ ID NO: 44064 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaagataagtgcaagata

SEQ ID NO: 44065 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctcttgaatttaaatatatg

SEQ ID NO: 44066 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgaatttaaatatatgtag

SEQ ID NO: 44067 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgaatttaaatatatgtagc

SEQ ID NO: 44068 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atatatgtagcaggatgata

SEQ ID NO: 44069 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgtagcaggatgatataga

SEQ ID NO: 44070 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagcaggatgatatagatag

SEQ ID NO: 44071 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagatagaagttctttgatc

SEQ ID NO: 44072 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
caagaccacaaaatcaaata

SEQ ID NO: 44073 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccattttgtatataacattt

SEQ ID NO: 44074 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtatataacattttagtata

SEQ ID NO: 44075 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tataacattttagtatatag

SEQ ID NO: 44076 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cattttagtatatagtagaa

SEQ ID NO: 44077 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atatagtagaaaagatcaaa

SEQ ID NO: 44078 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acagtattatttataatgtc

SEQ ID NO: 44079 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tattatttataatgtcaaga

SEQ ID NO: 44080 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatttataatgtcaagaaag

SEQ ID NO: 44081 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtcaagaaagtggctacta

SEQ ID NO: 44082 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagaaagtggctactaaagt

SEQ ID NO: 44083 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cacatgcaaactctgaaaca

SEQ ID NO: 44084 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaactctgaaacaaagatcg

SEQ ID NO: 44085 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agatcgaagaaaattaaaca

SEQ ID NO: 44086 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcgaagaaaattaaacatgg

SEQ ID NO: 44087 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaacatggcagacttacaca

SEQ ID NO: 44088 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cattgtcattatgatcatat

SEQ ID NO: 44089 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ataagtgatcataacgcaaa

SEQ ID NO: 44090 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taagtgatcataacgcaaat

SEQ ID NO: 44091 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcaaataggtttttctcacc

SEQ ID NO: 44092 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaataggtttttctcaccca

SEQ ID NO: 44093 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttctcacccagagctttat

SEQ ID NO: 44094 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cacatacacacacacacacg

SEQ ID NO: 44095 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atctttacaaaaaatacata

SEQ ID NO: 44096 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaaatacatacagcaactg

SEQ ID NO: 44097 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcccaaatattgttttata

SEQ ID NO: 44098 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcccaaatattgttttataa

SEQ ID NO: 44099 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccaaatattgttttataaag

SEQ ID NO: 44100 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tattgttttataaaggagta

SEQ ID NO: 44101 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgttttataaaggagtaaag

SEQ ID NO: 44102 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggagtaaagcagcatatcaa

SEQ ID NO: 44103 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtaaagcagcatatcaatgg

SEQ ID NO: 44104 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaagcagcatatcaatggaa

SEQ ID NO: 44105 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatgacatgtgaatattga

SEQ ID NO: 44106 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgtgaatattgaaagctac

SEQ ID NO: 44107 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacaacacaattctcttatt

SEQ ID NO: 44108 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agttacaactttatcttttt

SEQ ID NO: 44109 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttacaactttatctttttta

SEQ ID NO: 44110 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caactttatcttttttagag

SEQ ID NO: 44111 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatcttttttagagtagttc

SEQ ID NO: 44112 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttttagagtagttcaagc

SEQ ID NO: 44113 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agagtagttcaagcaagtgc

SEQ ID NO: 44114 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaataataaaatacttattt

SEQ ID NO: 44115 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgaatttgtattaatatga

SEQ ID NO: 44116 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taatatgatagcccaatcta

SEQ ID NO: 44117 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatatgatagcccaatctaa

SEQ ID NO: 44118 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caatctaaaggtttgacttt

SEQ ID NO: 44119 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atctaaaggtttgactttta

SEQ ID NO: 44120 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgacttttagagattgact

SEQ ID NO: 44121 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acttttagagattgacttgg

SEQ ID NO: 44122 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttagagattgacttggaagc

SEQ ID NO: 44123 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagattgacttggaagctag

SEQ ID NO: 44124 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaagctagaagtattcttga

SEQ ID NO: 44125 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aagctagaagtattcttgat

SEQ ID NO: 44126 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcaatgctattattatcacc

SEQ ID NO: 44127 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtatacaacatcataaaaa

SEQ ID NO: 44128 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaacatcataaaaatggca

SEQ ID NO: 44129 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcataaaaatggcatggata

SEQ ID NO: 44130 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atggataaagtattgtacat

SEQ ID NO: 44131 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggataaagtattgtacata

SEQ ID NO: 44132 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgtacataaggaatgatgt

SEQ ID NO: 44133 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tacataaggaatgatgtaag

SEQ ID NO: 44134 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gacaatgtctttcttataac

SEQ ID NO: 44135 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caatgtctttcttataactg

SEQ ID NO: 44136 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataattatgaacaacctatt

SEQ ID NO: 44137 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aattatgaacaacctattaa

SEQ ID NO: 44138 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agaactcctccaatctatgt

SEQ ID NO: 44139 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcctccaatctatgttggcc

SEQ ID NO: 44140 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctccaatctatgttggccta

SEQ ID NO: 44141 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tccaatctatgttggcctag

SEQ ID NO: 44142 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cctagaggcattattcccac

SEQ ID NO: 44143 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctagaggcattattcccacc

SEQ ID NO: 44144 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggcattattcccaccaggtc

SEQ ID NO: 44145 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcattattcccaccaggtcc

SEQ ID NO: 44146 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attattcccaccaggtccag

SEQ ID NO: 44147 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caggtccaggagtttgataa

SEQ ID NO: 44148 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caggagtttgataacagttt

SEQ ID NO: 44149 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gataacagtttcagttatga

SEQ ID NO: 44150 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtttcagttatgaaagtat

SEQ ID NO: 44151 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgattgaattcatctaaat

SEQ ID NO: 44152 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaattagtttaatttaaaat

SEQ ID NO: 44153 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttaatttaaaataagataa

SEQ ID NO: 44154 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgaatattctataaaacta

SEQ ID NO: 44155 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tattctataaaactatagaa

SEQ ID NO: 44156 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attctataaaactatagaat

SEQ ID NO: 44157 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaactatagaataggcttta

SEQ ID NO: 44158 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aggctttaaagtataaacta

SEQ ID NO: 44159 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taaagtataaactatagaat

SEQ ID NO: 44160 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaatgagttttaaaatatat

SEQ ID NO: 44161 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatatataagttttaaaata

SEQ ID NO: 44162 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttttaaaatacagattaatc

SEQ ID NO: 44163 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttaaaatacagattaatcc

SEQ ID NO: 44164 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attaatccaggaaacgatgt

SEQ ID NO: 44165 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gccaattgccacaaaatcca

SEQ ID NO: 44166 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaatccaaagtaccatatt

SEQ ID NO: 44167 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atccaaagtaccatatttag

SEQ ID NO: 44168 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtaccatatttagaagacta

SEQ ID NO: 44169 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttagaagactacagttttaa

SEQ ID NO: 44170 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ggcttcaattcctgacctct

SEQ ID NO: 44171 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggctgcacgtgaactatcac

SEQ ID NO: 44172 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgcacgtgaactatcacca

SEQ ID NO: 44173 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cacgtgaactatcaccagag

SEQ ID NO: 44174 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aactatcaccagagaagtga

SEQ ID NO: 44175 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcaccagagaagtgaaagac

SEQ ID NO: 44176 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caccagagaagtgaaagaca

SEQ ID NO: 44177 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaggccctattattctgtg

SEQ ID NO: 44178 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccctattattctgtgaagtt

SEQ ID NO: 44179 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttattctgtgaagttaagac

SEQ ID NO: 44180 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tattctgtgaagttaagacc

SEQ ID NO: 44181 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggcccttcatttctgaaaa

SEQ ID NO: 44182 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atttctgaaaaaagaattat

SEQ ID NO: 44183 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgaaaaaagaattattggcc

SEQ ID NO: 44184 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaaaaaagaattattggcct

SEQ ID NO: 44185 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaattattggcctgggtttt

SEQ ID NO: 44186 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aattattggcctgggttttg

SEQ ID NO: 44187 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttggcctgggttttgaggta

SEQ ID NO: 44188 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcctgggttttgaggtaaag

SEQ ID NO: 44189 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gggttttgaggtaaagcagt

SEQ ID NO: 44190 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gttttgaggtaaagcagtga

SEQ ID NO: 44191 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttttgaggtaaagcagtgag

SEQ ID NO: 44192 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcagtgagaggaattgctga

SEQ ID NO: 44193 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgagaggaattgctgataga

SEQ ID NO: 44194 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgctgatagaaagaataca

SEQ ID NO: 44195 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acaaagcacccccctgctat

SEQ ID NO: 44196 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attagacacaatattaacaa

SEQ ID NO: 44197 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttagacacaatattaacaat

SEQ ID NO: 44198 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acaatattaacaataggaaa

SEQ ID NO: 44199 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaataggaaatagttataa

SEQ ID NO: 44200 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agttataatggtttttctct

SEQ ID NO: 44201 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ataatggtttttctctgagc

SEQ ID NO: 44202 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aataaaatgattcttatttg

SEQ ID NO: 44203 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatttgcagaattctgactt

SEQ ID NO: 44204 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gactttagctaaattcatga

SEQ ID NO: 44205 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catcttcaaacatcaataat

SEQ ID NO: 44206 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattggttttctcactgttt

SEQ ID NO: 44207 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttggttttctcactgtttaa

SEQ ID NO: 44208 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggttttctcactgtttaaga

SEQ ID NO: 44209 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtttaagagagcattaaca

SEQ ID NO: 44210 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aacaaagatttatgccaaat

SEQ ID NO: 44211 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttatgccaaattagattat

SEQ ID NO: 44212 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgccaaattagattatgagc

SEQ ID NO: 44213 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaattcacgtgattttata

SEQ ID NO: 44214 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgaaactttttttcatatg

SEQ ID NO: 44215 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgaaactttttttcatatgc

SEQ ID NO: 44216 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caggttttatgtttttttaa

SEQ ID NO: 44217 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttttaatggtcaattgaatt

SEQ ID NO: 44218 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atggtcaattgaattcagct

SEQ ID NO: 44219 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caattgaattcagcttggca

SEQ ID NO: 44220 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcacagaattttacatcata

SEQ ID NO: 44221 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tattcaatattattgttcaa

SEQ ID NO: 44222 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
attcaatattattgttcaat

SEQ ID NO: 44223 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatattattgttcaatggga

SEQ ID NO: 44224 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tattaattaatttgtattta

SEQ ID NO: 44225 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatttacagacaaattatta

SEQ ID NO: 44226 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agacaaattattatggctaa

SEQ ID NO: 44227 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tattatggctaatagattct

SEQ ID NO: 44228 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttagacattcaatgttttct

SEQ ID NO: 44229 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tagacattcaatgttttctt

SEQ ID NO: 44230 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgttttcttgggaatgcatt

SEQ ID NO: 44231 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaatgcattaagtattcaaa

SEQ ID NO: 44232 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atataaaattaaatgtttat

SEQ ID NO: 44233 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatgtttataagcatgctt

SEQ ID NO: 44234 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ataagcatgctttagcaata

SEQ ID NO: 44235 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcatgctttagcaatataga

SEQ ID NO: 44236 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttagcaatatagacagttc

SEQ ID NO: 44237 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atagacagttctagtcaatt

SEQ ID NO: 44238 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttgaaatctatacttgcta

SEQ ID NO: 44239 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atctatacttgctacagtat

SEQ ID NO: 44240 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgctacagtataagcttctt

SEQ ID NO: 44241 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tacagtataagcttctttag

SEQ ID NO: 44242 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcttctttagcagatttct

SEQ ID NO: 44243 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cttctttagcagatttctaa

SEQ ID NO: 44244 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctaagagaatacctttata

SEQ ID NO: 44245 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agagaatacctttatataga

SEQ ID NO: 44246 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagaatacctttatatagaa

SEQ ID NO: 44247 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaggctgatatatataata

SEQ ID NO: 44248 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aataaagtttttttttcctg

SEQ ID NO: 44249 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgaaatatattgaattctca

SEQ ID NO: 44250 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatatattgaattctcacag

SEQ ID NO: 44251 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atatattgaattctcacagt

SEQ ID NO: 44252 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagtaggcatcaccatattt

SEQ ID NO: 44253 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatatgttttttactatac

SEQ ID NO: 44254 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatatgttttttactataca

SEQ ID NO: 44255 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgttttttactatacaagg

SEQ ID NO: 44256 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaactcaatcatctgttgtt

SEQ ID NO: 44257 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttagttttccatgtaattt

SEQ ID NO: 44258 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccatgtaattttggaaatga

SEQ ID NO: 44259 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatgaaagaatgactatat

SEQ ID NO: 44260 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgaaagaatgactatatta

SEQ ID NO: 44261 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagaatgactatattagag

SEQ ID NO: 44262 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagaagtgaaataaatgctt

SEQ ID NO: 44263 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaataaatgctttagtatga

SEQ ID NO: 44264 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atttcttttgctattataaa

SEQ ID NO: 44265 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttcttttgctattataaat

SEQ ID NO: 44266 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaccttctgtaattttcaca

SEQ ID NO: 44267 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atggatttgatttctaataa

SEQ ID NO: 44268 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggatttgatttctaataaa

SEQ ID NO: 44269 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggatttgatttctaataaaa

SEQ ID NO: 44270 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttgatttctaataaaaggg

SEQ ID NO: 44271 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtatcaatttttttcatcat

SEQ ID NO: 44272 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcaatttttttcatcattgg

SEQ ID NO: 44273 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttttcatcattggcagtc

SEQ ID NO: 44274 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggcagtctagttataaata

SEQ ID NO: 44275 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aataaagtaaatataaatat

SEQ ID NO: 44276 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtaaatataaatataagca

SEQ ID NO: 44277 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtaaatataaatataagcat

SEQ ID NO: 44278 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataaatataagcataggatc

SEQ ID NO: 44279 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatataagcataggatcaag

SEQ ID NO: 44280 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atataagcataggatcaaga

SEQ ID NO: 44281 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taagcataggatcaagaagg

SEQ ID NO: 44282 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gatcaagaaggtggactcac

SEQ ID NO: 44283 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaaggtggactcactagtat

SEQ ID NO: 44284 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaggtggactcactagtatt

SEQ ID NO: 44285 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gactcactagtattaggaat

SEQ ID NO: 44286 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcactagtattaggaatcag

SEQ ID NO: 44287 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatcagaagtgtaccataat

SEQ ID NO: 44288 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atattgactgtgccttctaa

SEQ ID NO: 44289 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagtgttttaaaaatatga

SEQ ID NO: 44290 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttaaaaatatgaaagtgata

SEQ ID NO: 44291 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caaacattttaaatgtataa

SEQ ID NO: 44292 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaatgtataatagtattta

SEQ ID NO: 44293 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtatttacagtgcaaaataa

SEQ ID NO: 44294 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctccttgattcaaccccctt

SEQ ID NO: 44295 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tccttgattcaacccccttg

SEQ ID NO: 44296 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcaacccccttgaggtaatc

SEQ ID NO: 44297 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aacccccttgaggtaatcga

SEQ ID NO: 44298 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cccccttgaggtaatcgaga

SEQ ID NO: 44299 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cccttgaggtaatcgagaga

SEQ ID NO: 44300 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggtaatcgagagagagaaa

SEQ ID NO: 44301 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtaatcgagagagagaaaaa

SEQ ID NO: 44302 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatcgagagagagaaaaaga

SEQ ID NO: 44303 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcgagagagagaaaaagaga

SEQ ID NO: 44304 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gagagagagaaaaagagaga

SEQ ID NO: 44305 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agagagagaaaaagagagag

SEQ ID NO: 44306 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agagagaaaaagagagagag

SEQ ID NO: 44307 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agagaaaaagagagagagga

SEQ ID NO: 44308 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaaaaagagagagaggaga

SEQ ID NO: 44309 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaaagagagagaggagaga

SEQ ID NO: 44310 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaagagagagaggagagaga

SEQ ID NO: 44311 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agagagagaggagagagaga

SEQ ID NO: 44312 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agagagaggagagagagaga

SEQ ID NO: 44313 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agagaggagagagagagaga

SEQ ID NO: 44314 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaggagagagagagagaga

SEQ ID NO: 44315 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aggagagagagagagagaga

SEQ ID NO: 44316 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gagagagagagagagagaga

SEQ ID NO: 44317 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gagagagagagagagagaga

SEQ ID NO: 44318 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acatatctttccatattttt

SEQ ID NO: 44319 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtgcatccatacaacacta

SEQ ID NO: 44320 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atcttgattgtaaacttatg

SEQ ID NO: 44321 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtaaacttatgtagctattt

SEQ ID NO: 44322 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaaaatatgtccaaattaa

SEQ ID NO: 44323 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaagctttattattcttca

SEQ ID NO: 44324 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttccctttgattgccttg

SEQ ID NO: 44325 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgttttctactatactgctt

SEQ ID NO: 44326 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttctactatactgcttgag

SEQ ID NO: 44327 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttaaatatatgtatcatat

SEQ ID NO: 44328 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atcatattagaacatgtcct

SEQ ID NO: 44329 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcacttacaaatttatcac

SEQ ID NO: 44330 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atttatcactggcatttcct

SEQ ID NO: 44331 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagataaacattaacgatgt

SEQ ID NO: 44332 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagcctatttcatgctatca

SEQ ID NO: 44333 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttcatgctatcatggatga

SEQ ID NO: 44334 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcatggatgatggttaatgc

SEQ ID NO: 44335 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgctagttatttattgttcc

SEQ ID NO: 44336 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctagttatttattgttccaa

SEQ ID NO: 44337 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tagttatttattgttccaag

SEQ ID NO: 44338 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttattgttccaagaggtgt

SEQ ID NO: 44339 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttattgttccaagaggtgtg

SEQ ID NO: 44340 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgttccaagaggtgtgagg

SEQ ID NO: 44341 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgttccaagaggtgtgaggt

SEQ ID NO: 44342 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttccaagaggtgtgaggtag

SEQ ID NO: 44343 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttgataatctaacgctcaa

SEQ ID NO: 44344 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gataatctaacgctcaaaag

SEQ ID NO: 44345 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaagaagaaactatcaaaca

SEQ ID NO: 44346 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaagaaactatcaaacacag

SEQ ID NO: 44347 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagcagcactgtacaaaaca

SEQ ID NO: 44348 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctcaacaaaaaccttactca

SEQ ID NO: 44349 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caacaaaaaccttactcaaa

SEQ ID NO: 44350 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agagaatgattgatgctgaa

SEQ ID NO: 44351 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actgaaaaatgttacatttc

SEQ ID NO: 44352 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcttcacacaacaaaaaaa

SEQ ID NO: 44353 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaaaaaaaagatattcttt

SEQ ID NO: 44354 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaaaaaaagatattcttta

SEQ ID NO: 44355 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaaaaagatattctttaag

SEQ ID NO: 44356 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaagatattctttaaggag

SEQ ID NO: 44357 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagatattctttaaggagca

SEQ ID NO: 44358 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attctttaaggagcagagcc

SEQ ID NO: 44359 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttaaggagcagagcctagaa

SEQ ID NO: 44360 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctagaatggttatttcacct

SEQ ID NO: 44361 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagccttaaaatactcacaa

SEQ ID NO: 44362 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttaaaatactcacaaaaga

SEQ ID NO: 44363 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatactcacaaaagacagt

SEQ ID NO: 44364 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actcacaaaagacagtaaga

SEQ ID NO: 44365 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caaaagacagtaagaaagtt

SEQ ID NO: 44366 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaagacagtaagaaagttga

SEQ ID NO: 44367 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gacagtaagaaagttgagag

SEQ ID NO: 44368 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agttgagagaagcaaatcaa

SEQ ID NO: 44369 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gttgagagaagcaaatcaaa

SEQ ID NO: 44370 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgagagaagcaaatcaaaag

SEQ ID NO: 44371 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagagaagcaaatcaaaagg

SEQ ID NO: 44372 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gagaagcaaatcaaaaggag

SEQ ID NO: 44373 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agcaaatcaaaaggaggaga

SEQ ID NO: 44374 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcaaatcaaaaggaggagat

SEQ ID NO: 44375 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaggaggagatgggtataa

SEQ ID NO: 44376 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aggaggagatgggtataaaa

SEQ ID NO: 44377 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggagatgggtataaaagag

SEQ ID NO: 44378 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ataaaagagaagaaaaatta

SEQ ID NO: 44379 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaagagaagaaaaattatgg

SEQ ID NO: 44380 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaagaaaaattatggcaga

SEQ ID NO: 44381 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agaaaaattatggcagacag

SEQ ID NO: 44382 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atggcagacagtggtaaact

SEQ ID NO: 44383 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagctccattatctgttaat

SEQ ID NO: 44384 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tccattatctgttaataagc

SEQ ID NO: 44385 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatctgttaataagcaaga

SEQ ID NO: 44386 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caagaaagacattttaaaat

SEQ ID NO: 44387 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gacattttaaaattagtttc

SEQ ID NO: 44388 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catcttttaatttaattgtg

SEQ ID NO: 44389 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aatttaattgtgtagtttta

SEQ ID NO: 44390 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattgtgttcttgaatcatt

SEQ ID NO: 44391 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attgtgttcttgaatcatta

SEQ ID NO: 44392 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtgttcttgaatcattaag

SEQ ID NO: 44393 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgaatcattaaggagtaaaa

SEQ ID NO: 44394 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaatagtaaatttcaatta

SEQ ID NO: 44395 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaatagtaaatttcaattaa

SEQ ID NO: 44396 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatttcaattaaaggatca

SEQ ID NO: 44397 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatttcaattaaaggatcaa

SEQ ID NO: 44398 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaggatcaaaggatccttt

SEQ ID NO: 44399 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggatcaaaggatcctttgag

SEQ ID NO: 44400 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttgagaagaaatccacaca

SEQ ID NO: 44401 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atccacacatagttactatg

SEQ ID NO: 44402 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acatagttactatgtggcat

SEQ ID NO: 44403 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atagttactatgtggcataa

SEQ ID NO: 44404 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataagagtccaatattttcc

SEQ ID NO: 44405 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccaagtttcccattatgtta

SEQ ID NO: 44406 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caagtttcccattatgttac

SEQ ID NO: 44407 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccattatgttacaggacaac

SEQ ID NO: 44408 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gatgtttaaatactctcttc

SEQ ID NO: 44409 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttaaatactctcttctggtg

SEQ ID NO: 44410 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcttctctcttgcaatcatt

SEQ ID NO: 44411 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttctctcttgcaatcattc

SEQ ID NO: 44412 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttctctcttgcaatcattca

SEQ ID NO: 44413 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggcctttatttttttccttc

SEQ ID NO: 44414 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cctttatttttttccttctg

SEQ ID NO: 44415 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgtgaacattatcctctta

SEQ ID NO: 44416 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtgaacattatcctcttata

SEQ ID NO: 44417 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcttatagagtttttaaaat

SEQ ID NO: 44418 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttatagagtttttaaaattg

SEQ ID NO: 44419 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatagagtttttaaaattgg

SEQ ID NO: 44420 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatattattgatattactat

SEQ ID NO: 44421 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctattagtgcttttcatctt

SEQ ID NO: 44422 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcacatttcttaacatgatt

SEQ ID NO: 44423 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cttaacatgatttagatttc

SEQ ID NO: 44424 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttaacatgatttagatttct

SEQ ID NO: 44425 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttagatttctgggcccctt

SEQ ID NO: 44426 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttagatttctgggccccttg

SEQ ID NO: 44427 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttttgatatgaaatttctc

SEQ ID NO: 44428 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttctcaagattctttttaa

SEQ ID NO: 44429 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttctcaagattctttttaaa

SEQ ID NO: 44430 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttttaaaaggtaatgcctc

SEQ ID NO: 44431 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctcaagttaaaaaatcactg

SEQ ID NO: 44432 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttaaaaaatcactgaagct

SEQ ID NO: 44433 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttaaaaaatcactgaagctc

SEQ ID NO: 44434 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcactgaagctcaggaattt

SEQ ID NO: 44435 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cactgaagctcaggaatttc

SEQ ID NO: 44436 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caggaatttcaggaaaaaaa

SEQ ID NO: 44437 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaaataattaaaaaatactc

SEQ ID NO: 44438 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atactccagatattattgat

SEQ ID NO: 44439 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctccagatattattgatcag

SEQ ID NO: 44440 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtattttcttctgttgtct

SEQ ID NO: 44441 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taatgttacttccactaatt

SEQ ID NO: 44442 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgttacttccactaatttag

SEQ ID NO: 44443 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctaatttagcagaaaattgt

SEQ ID NO: 44444 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaattgtcagtttattaac

SEQ ID NO: 44445 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taactagttgcaataaattc

SEQ ID NO: 44446 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aactagttgcaataaattct

SEQ ID NO: 44447 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctgggctcacattctaatta

SEQ ID NO: 44448 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgggctcacattctaattat

SEQ ID NO: 44449 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attatgggcaactaaaactt

SEQ ID NO: 44450 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttagctctttttttaaaaa

SEQ ID NO: 44451 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttagctctttttttaaaaaa

SEQ ID NO: 44452 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tagctctttttttaaaaaaa

SEQ ID NO: 44453 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctttttttaaaaaaagggc

SEQ ID NO: 44454 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatttttctttgtctattgc

SEQ ID NO: 44455 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttttctttgtctattgctag

SEQ ID NO: 44456 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttctttgtctattgctagca

SEQ ID NO: 44457 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gctagcagagaaatattgtg

SEQ ID NO: 44458 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctagcagagaaatattgtgt

SEQ ID NO: 44459 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gagaaatattgtgtaggctc

SEQ ID NO: 44460 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agaaatattgtgtaggctct

SEQ ID NO: 44461 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaatattgtgtaggctctgg

SEQ ID NO: 44462 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatattgtgtaggctctggg

SEQ ID NO: 44463 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtgtaggctctgggaggaa

SEQ ID NO: 44464 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gggaggaatagctacttatt

SEQ ID NO: 44465 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttattcagcgtgaaacaca

SEQ ID NO: 44466 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaacacacagttccatcac

SEQ ID NO: 44467 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaacacacagttccatcaca

SEQ ID NO: 44468 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cacaaggtcaacatgatata

SEQ ID NO: 44469 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catgatatatagtattctgt

SEQ ID NO: 44470 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tattctgttggtgaaataat

SEQ ID NO: 44471 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attctgttggtgaaataatg

SEQ ID NO: 44472 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaaataatgaggtcaaatct

SEQ ID NO: 44473 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggtcaaatctcagccaccac

SEQ ID NO: 44474 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcaaatctcagccaccacca

SEQ ID NO: 44475 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagccaccaccagagaaatt

SEQ ID NO: 44476 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agagaaattcagaataaaac

SEQ ID NO: 44477 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gaataaaaccagtgatttca

SEQ ID NO: 44478 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ataaaaccagtgatttcacg

SEQ ID NO: 44479 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cggagacctcttctttttct

SEQ ID NO: 44480 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttctcagaatcttctacc

SEQ ID NO: 44481 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttctcagaatcttctacct

SEQ ID NO: 44482 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttctcagaatcttctaccta

SEQ ID NO: 44483 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacttacgtgactaaatgat

SEQ ID NO: 44484 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgataagatatgaatata

SEQ ID NO: 44485 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatataaagaaatcatataa

SEQ ID NO: 44486 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaatcatataaaagcaacaa

SEQ ID NO: 44487 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catataaaagcaacaacagt

SEQ ID NO: 44488 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcaacaacagttggccatgt

SEQ ID NO: 44489 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acaacagttggccatgtaag

SEQ ID NO: 44490 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caacagttggccatgtaaga

SEQ ID NO: 44491 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agttggccatgtaagaaggc

SEQ ID NO: 44492 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gccatgtaagaaggctagac

SEQ ID NO: 44493 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taagaaggctagactggcta

SEQ ID NO: 44494 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tagactggctacagatttct

SEQ ID NO: 44495 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctggctacagatttctcagc

SEQ ID NO: 44496 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggctacagatttctcagcc

SEQ ID NO: 44497 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gatttctcagccaggtccta

SEQ ID NO: 44498 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggtcctatagtatcatcttg

SEQ ID NO: 44499 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaagcatctttctaatgaa

SEQ ID NO: 44500 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcatctttctaatgaaaag

SEQ ID NO: 44501 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
catctttctaatgaaaagaa

SEQ ID NO: 44502 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctttctaatgaaaagaagag

SEQ ID NO: 44503 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taatgaaaagaagagaagca

SEQ ID NO: 44504 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgaaaagaagagaagcaaa

SEQ ID NO: 44505 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaagaagagaagcaaagagc

SEQ ID NO: 44506 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagaagagaagcaaagagct

SEQ ID NO: 44507 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaagagaagcaaagagctag

SEQ ID NO: 44508 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcaaagagctaggagtgta

SEQ ID NO: 44509 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaagagctaggagtgtaaag

SEQ ID NO: 44510 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaagtggccattgatattc

SEQ ID NO: 44511 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaagtggccattgatattca

SEQ ID NO: 44512 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aagtggccattgatattcaa

SEQ ID NO: 44513 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gctctctctgtgctctgtca

SEQ ID NO: 44514 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagaactgctacactgtttg

SEQ ID NO: 44515 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaactgctacactgtttgca

SEQ ID NO: 44516 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgctacactgtttgcagaga

SEQ ID NO: 44517 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tacactgtttgcagagaaag

SEQ ID NO: 44518 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctgtttgcagagaaagcagc

SEQ ID NO: 44519 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagagaaagcagctggaata

SEQ ID NO: 44520 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agaaagcagctggaatacag

SEQ ID NO: 44521 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaaagcagctggaatacagt

SEQ ID NO: 44522 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagctggaatacagtgggtc

SEQ ID NO: 44523 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tggaatacagtgggtcaagt

SEQ ID NO: 44524 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaatacagtgggtcaagtca

SEQ ID NO: 44525 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggtcaagtcagagtgtctta

SEQ ID NO: 44526 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcagagtgtcttaaagtctt

SEQ ID NO: 44527 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagtgtcttaaagtctttag

SEQ ID NO: 44528 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacaattttgctatttatgc

SEQ ID NO: 44529 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccagcttaaaaaaatgcaac

SEQ ID NO: 44530 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcttaaaaaaatgcaacaag

SEQ ID NO: 44531 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttaaaaaaatgcaacaagt

SEQ ID NO: 44532 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaatgcaacaagtaggta

SEQ ID NO: 44533 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgcaacaagtaggtaaag

SEQ ID NO: 44534 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgcaacaagtaggtaaaga

SEQ ID NO: 44535 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaagtaggtaaagaaggat

SEQ ID NO: 44536 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtaaagaaggattggaacct

SEQ ID NO: 44537 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttggaaccttagcaaacata

SEQ ID NO: 44538 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggaaccttagcaaacataa

SEQ ID NO: 44539 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccttagcaaacataaaggca

SEQ ID NO: 44540 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcaaacataaaggcaaagtg

SEQ ID NO: 44541 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaggcaaagtgtagatacg

SEQ ID NO: 44542 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagtgtagatacgcagactc

SEQ ID NO: 44543 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctataattttgaaacaaac

SEQ ID NO: 44544 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaacaagaatgacaaacaca

SEQ ID NO: 44545 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagaatgacaaacacaaagt

SEQ ID NO: 44546 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caaacacaaagtaagctacc

SEQ ID NO: 44547 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tactaatactacccacaatg

SEQ ID NO: 44548 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actaatactacccacaatga

SEQ ID NO: 44549 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taatactacccacaatgaag

SEQ ID NO: 44550 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatactacccacaatgaagg

SEQ ID NO: 44551 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atactacccacaatgaagga

SEQ ID NO: 44552 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacccacaatgaaggagggc

SEQ ID NO: 44553 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acccacaatgaaggagggca

SEQ ID NO: 44554 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caatgaaggagggcaaggaa

SEQ ID NO: 44555 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaaaagtgaattttaatgaa

SEQ ID NO: 44556 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttaatgaatggaataattac

SEQ ID NO: 44557 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttactagctttttaaacatg

SEQ ID NO: 44558 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctaatattgaaaatataaa

SEQ ID NO: 44559 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atataaatagaaattttaca

SEQ ID NO: 44560 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaataactatatcctttatg

SEQ ID NO: 44561 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aataactatatcctttatgt

SEQ ID NO: 44562 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aactatatcctttatgtagg

SEQ ID NO: 44563 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatgtaggcagcttttgcta

SEQ ID NO: 44564 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgctaaagtgccatatttc

SEQ ID NO: 44565 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtcattcttaactgaatatt

SEQ ID NO: 44566 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaatattcagtttttttctt

SEQ ID NO: 44567 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atattcagtttttttcttaa

SEQ ID NO: 44568 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tattcagtttttttcttaag

SEQ ID NO: 44569 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgtacctcatcttttctaa

SEQ ID NO: 44570 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cctcatcttttctaacagct

SEQ ID NO: 44571 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttctaacagcttggtaaaa

SEQ ID NO: 44572 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagcttggtaaaaaagtaat

SEQ ID NO: 44573 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatgcatgtatatatatttc

SEQ ID NO: 44574 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtatatatatttctagaaa

SEQ ID NO: 44575 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgttttatctatacctata

SEQ ID NO: 44576 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatacctatatagataatat

SEQ ID NO: 44577 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atacctatatagataatatt

SEQ ID NO: 44578 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggtgtatatgcatccttatt

SEQ ID NO: 44579 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtgtatatgcatccttattt

SEQ ID NO: 44580 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgcatccttatttaggctc

SEQ ID NO: 44581 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccttatttaggctctagttg

SEQ ID NO: 44582 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaagaaaattcaccatattc

SEQ ID NO: 44583 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caccatattctggaataaaa

SEQ ID NO: 44584 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggaataaaatagttttctat

SEQ ID NO: 44585 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatccccaccaaatttgaaa

SEQ ID NO: 44586 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agaaaaatatatcttttact

SEQ ID NO: 44587 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaaaatatatcttttactt

SEQ ID NO: 44588 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaattatcttcaaataaac

SEQ ID NO: 44589 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatttttcatttgaaactgt

SEQ ID NO: 44590 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgttagcaatattatctct

SEQ ID NO: 44591 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgttagcaatattatctcta

SEQ ID NO: 44592 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctctaaggtgtgtcaattt

SEQ ID NO: 44593 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctctaaggtgtgtcaatttc

SEQ ID NO: 44594 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggtgtgtcaatttcaggata

SEQ ID NO: 44595 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgctttcatcattgcacaa

SEQ ID NO: 44596 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tacaaacatctcaacaatga

SEQ ID NO: 44597 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caaacatctcaacaatgaca

SEQ ID NO: 44598 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagaaattcaaaatatgaac

SEQ ID NO: 44599 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatatgaactagattataaa

SEQ ID NO: 44600 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atatgaactagattataaaa

SEQ ID NO: 44601 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgaactagattataaaaag

SEQ ID NO: 44602 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctagattataaaaaggagtc

SEQ ID NO: 44603 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaggagtcaagattcttat

SEQ ID NO: 44604 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggagtcaagattcttattgg

SEQ ID NO: 44605 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtcaagattcttattggca

SEQ ID NO: 44606 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agagattcctgcccccatcc

SEQ ID NO: 44607 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cccccatcctagaactatta

SEQ ID NO: 44608 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atcctagaactattaaagtt

SEQ ID NO: 44609 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaagttcagtcattcaaca

SEQ ID NO: 44610 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gctaaaattaaaatatatct

SEQ ID NO: 44611 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtatgtattttaatacattt

SEQ ID NO: 44612 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acattttagaaatattcaat

SEQ ID NO: 44613 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cattttagaaatattcaata

SEQ ID NO: 44614 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tattaatctgtatctaattt

SEQ ID NO: 44615 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctgtatctaatttcagtaa

SEQ ID NO: 44616 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtgttctatgtgttattga

SEQ ID NO: 44617 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttctatgtgttattgataga

SEQ ID NO: 44618 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctatgtgttattgatagat

SEQ ID NO: 44619 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatgctctatctaaacctct

SEQ ID NO: 44620 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatctaaacctcttagtttc

SEQ ID NO: 44621 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctaaacctcttagtttcta

SEQ ID NO: 44622 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gatctgattatgtatataat

SEQ ID NO: 44623 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaaacttattcttatcaat

SEQ ID NO: 44624 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcaatgagtaatattacttc

SEQ ID NO: 44625 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acttatcacttattcattca

SEQ ID NO: 44626 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttatcacttattcattcat

SEQ ID NO: 44627 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcacttattcattcataggc

SEQ ID NO: 44628 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cacttattcattcataggca

SEQ ID NO: 44629 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttaactgatgcattttata

SEQ ID NO: 44630 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttaactgatgcattttatat

SEQ ID NO: 44631 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aactgatgcattttatatag

SEQ ID NO: 44632 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaatcaaatgttaattact

SEQ ID NO: 44633 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgagttgatttaaaaaaata

SEQ ID NO: 44634 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaataaagtcccataactaa

SEQ ID NO: 44635 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
accatttcaaaatgtattca

SEQ ID NO: 44636 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatgtattcaaagtttatac

SEQ ID NO: 44637 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtattcaaagtttatactag

SEQ ID NO: 44638 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcaaagtttatactagaag

SEQ ID NO: 44639 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcaaagtttatactagaagc

SEQ ID NO: 44640 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caaagtttatactagaagca

SEQ ID NO: 44641 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atactagaagcagggtactt

SEQ ID NO: 44642 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tggctttgaccccaactttc

SEQ ID NO: 44643 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caactttctagatgtgtact

SEQ ID NO: 44644 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttctagatgtgtactaaga

SEQ ID NO: 44645 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gatgtgtactaagaaagcat

SEQ ID NO: 44646 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttatccataaatacataac

SEQ ID NO: 44647 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaccagaattattaaataca

SEQ ID NO: 44648 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agaattattaaatacaaagc

SEQ ID NO: 44649 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caatgatcttttcctgctct

SEQ ID NO: 44650 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgagattttatatttatgc

SEQ ID NO: 44651 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acacttcttccacaattttt

SEQ ID NO: 44652 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acttcttccacaatttttta

SEQ ID NO: 44653 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catctctccatatttttatg

SEQ ID NO: 44654 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatttttatgtagattaaat

SEQ ID NO: 44655 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atttttatgtagattaaatc

SEQ ID NO: 44656 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttatgtagattaaatcagg

SEQ ID NO: 44657 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttatgtagattaaatcagga

SEQ ID NO: 44658 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tatgtagattaaatcaggaa

SEQ ID NO: 44659 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtagattaaatcaggaaggg

SEQ ID NO: 44660 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatcaggaagggaagttga

SEQ ID NO: 44661 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atcaggaagggaagttgata

SEQ ID NO: 44662 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcaggaagggaagttgatag

SEQ ID NO: 44663 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agaggttttcaaattaaatg

SEQ ID NO: 44664 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caaattaaatgtagcttcaa

SEQ ID NO: 44665 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atcaattcaataaaaatcta

SEQ ID NO: 44666 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcatgcacttgaaatcactt

SEQ ID NO: 44667 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaaatcacttaagcacatg

SEQ ID NO: 44668 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaatcacttaagcacatga

SEQ ID NO: 44669 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagcacatgaaggttacatc

SEQ ID NO: 44670 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cacatgaaggttacatcaag

SEQ ID NO: 44671 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggttacatcaagaagtcatc

SEQ ID NO: 44672 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttacatcaagaagtcatcaa

SEQ ID NO: 44673 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaaaataatcaaattgccc

SEQ ID NO: 44674 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatatgtttctactttcttg

SEQ ID NO: 44675 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgtttctactttcttgcag

SEQ ID NO: 44676 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgtttctactttcttgcagt

SEQ ID NO: 44677 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctactttcttgcagtgggt

SEQ ID NO: 44678 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctactttcttgcagtgggtc

SEQ ID NO: 44679 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctttcttgcagtgggtcagg

SEQ ID NO: 44680 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttgcagtgggtcaggcaga

SEQ ID NO: 44681 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgcagtgggtcaggcagaa

SEQ ID NO: 44682 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggtcaggcagaaaggttttg

SEQ ID NO: 44683 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaaaggttttgtagctgaa

SEQ ID NO: 44684 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttgtagctgaacagcatgc

SEQ ID NO: 44685 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatcgtatgtatgatttttt

SEQ ID NO: 44686 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atcgtatgtatgattttttt

SEQ ID NO: 44687 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttttaggtaacctgtgtaa

SEQ ID NO: 44688 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttaggtaacctgtgtaaaag

SEQ ID NO: 44689 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggtgacatatgtctctgcc

SEQ ID NO: 44690 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatgtctctgcctggttaa

SEQ ID NO: 44691 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctctgcctggttaaaagca

SEQ ID NO: 44692 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctgcctggttaaaagcaca

SEQ ID NO: 44693 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agctgcatccttgactgatc

SEQ ID NO: 44694 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagtttgatattacccctgt

SEQ ID NO: 44695 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttgatattacccctgtgag

SEQ ID NO: 44696 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatattacccctgtgagaag

SEQ ID NO: 44697 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atattacccctgtgagaaga

SEQ ID NO: 44698 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacccctgtgagaagaaggt

SEQ ID NO: 44699 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acccctgtgagaagaaggtt

SEQ ID NO: 44700 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaaggttaggtactgaattt

SEQ ID NO: 44701 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggtactgaattttagaaatg

SEQ ID NO: 44702 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttagaaatgcagcatgatga

SEQ ID NO: 44703 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaaatgcagcatgatgaaa

SEQ ID NO: 44704 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgcagcatgatgaaagagtt

SEQ ID NO: 44705 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actgtgttttaaaatgttta

SEQ ID NO: 44706 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtttaaagtcatatacctgt

SEQ ID NO: 44707 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaagtcatatacctgtaag

SEQ ID NO: 44708 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atatacctgtaagtagaaat

SEQ ID NO: 44709 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaattagttacatatttga

SEQ ID NO: 44710 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catgctatatactcaacgtt

SEQ ID NO: 44711 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taagcaatatatttgaatca

SEQ ID NO: 44712 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatatttgaatcacagtact

SEQ ID NO: 44713 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taagattaaatgtcattcaa

SEQ ID NO: 44714 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agattaaatgtcattcaaca

SEQ ID NO: 44715 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttaaaaacaatcaattaaa

SEQ ID NO: 44716 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttctatttttccttaaatgc

SEQ ID NO: 44717 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcaagcaacatttaaatat

SEQ ID NO: 44718 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atttaaatataagtgattct

SEQ ID NO: 44719 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatataagtgattctcagta

SEQ ID NO: 44720 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atataagtgattctcagtat

SEQ ID NO: 44721 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tataagtgattctcagtata

SEQ ID NO: 44722 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ataagtgattctcagtatag

SEQ ID NO: 44723 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taagtgattctcagtatagg

SEQ ID NO: 44724 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgattctcagtatagggggt

SEQ ID NO: 44725 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gattctcagtatagggggtg

SEQ ID NO: 44726 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctcagtatagggggtgagg

SEQ ID NO: 44727 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagtatagggggtgaggtgg

SEQ ID NO: 44728 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atagggggtgaggtggcagt

SEQ ID NO: 44729 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agggggtgaggtggcagtaa

SEQ ID NO: 44730 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaggtggcagtaagagtatg

SEQ ID NO: 44731 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taagagtatgcagctttaaa

SEQ ID NO: 44732 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaaaagcatattctaaaat

SEQ ID NO: 44733 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attaattttgacattttaaa

SEQ ID NO: 44734 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttaaacagcattgcaaaa

SEQ ID NO: 44735 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacagcattgcaaaaaagtg

SEQ ID NO: 44736 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tccaaatttatcaaaatata

SEQ ID NO: 44737 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttatcaaaatataaagaat

SEQ ID NO: 44738 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acacattgatttgaatatgt

SEQ ID NO: 44739 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gacaaatatttcattgtttt

SEQ ID NO: 44740 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acaaatatttcattgttttt

SEQ ID NO: 44741 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcacgtaaacaaatccaatg

SEQ ID NO: 44742 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtaaacaaatccaatgaaga

SEQ ID NO: 44743 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acaaatccaatgaagatgga

SEQ ID NO: 44744 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaaagatttttcaaattctt

SEQ ID NO: 44745 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aacaacctgaaaaaaacaaa

SEQ ID NO: 44746 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgaaaaaaacaaatggtct

SEQ ID NO: 44747 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atggtctaagtgcaattcta

SEQ ID NO: 44748 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtctaagtgcaattctacag

SEQ ID NO: 44749 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctaagtgcaattctacagaa

SEQ ID NO: 44750 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaaatctatgcataaaata

SEQ ID NO: 44751 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caaatgccaattttacgaaa

SEQ ID NO: 44752 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actaatccctaaatctttca

SEQ ID NO: 44753 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagtcaaatgcatttttaa

SEQ ID NO: 44754 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagattattatattttcta

SEQ ID NO: 44755 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttattatattttctaaagtg

SEQ ID NO: 44756 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attttctaaagtgtagtaat

SEQ ID NO: 44757 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttctaaagtgtagtaataag

SEQ ID NO: 44758 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaagtgtagtaataagcag

SEQ ID NO: 44759 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaagtgtagtaataagcaga

SEQ ID NO: 44760 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaactttgattaaaaatcta

SEQ ID NO: 44761 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
actttgattaaaaatctaaa

SEQ ID NO: 44762 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttgattaaaaatctaaaga

SEQ ID NO: 44763 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attaaaaatctaaagagaga

SEQ ID NO: 44764 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagagagaaagtcttgataa

SEQ ID NO: 44765 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtgtaattaaaaccaccaca

SEQ ID NO: 44766 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaaaaccaccacatagtaa

SEQ ID NO: 44767 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taaaaccaccacatagtaaa

SEQ ID NO: 44768 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aggacattaaatatttaatt

SEQ ID NO: 44769 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggacattaaatatttaattt

SEQ ID NO: 44770 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atattgaaacaactttttat

SEQ ID NO: 44771 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tattgaaacaactttttatc

SEQ ID NO: 44772 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgactacatttcataataat

SEQ ID NO: 44773 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcataataataagcatattt

SEQ ID NO: 44774 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcatatttaagtatctcca

SEQ ID NO: 44775 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttgtaaactgaacactgaa

SEQ ID NO: 44776 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctgaacactgaatagatgaa

SEQ ID NO: 44777 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgaacactgaatagatgaat

SEQ ID NO: 44778 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acactgaatagatgaatggg

SEQ ID NO: 44779 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgaatagatgaatgggtgga

SEQ ID NO: 44780 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gggtggatagatgaatgaat

SEQ ID NO: 44781 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agatgaatgaatgagtgaat

SEQ ID NO: 44782 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gatgaatgaatgagtgaatc

SEQ ID NO: 44783 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaatgcttgttcctctgcct

SEQ ID NO: 44784 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccttctgtaccacatctgcc

SEQ ID NO: 44785 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaaattttctccatactgt

SEQ ID NO: 44786 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaattttctccatactgta

SEQ ID NO: 44787 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttctccatactgtaaggtc

SEQ ID NO: 44788 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catactgtaaggtctggtct

SEQ ID NO: 44789 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgccacctcctttcatgtg

SEQ ID NO: 44790 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cacctcctttcatgtgaagt

SEQ ID NO: 44791 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcctttcatgtgaagtcagc

SEQ ID NO: 44792 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catgtgaagtcagccagata

SEQ ID NO: 44793 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cttactcaatgcatcctcaa

SEQ ID NO: 44794 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcaatgcatcctcaatggac

SEQ ID NO: 44795 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcatcctcaatggactagtt

SEQ ID NO: 44796 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
actagtttagtgtcctgtta

SEQ ID NO: 44797 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattttttgtatatttacct

SEQ ID NO: 44798 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attttttgtatatttaccta

SEQ ID NO: 44799 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtatatttacctaaggtgc

SEQ ID NO: 44800 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttacctaaggtgcaagctat

SEQ ID NO: 44801 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acctaaggtgcaagctatta

SEQ ID NO: 44802 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcaatcaccctttacctttg

SEQ ID NO: 44803 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctttacctttgaagtacatg

SEQ ID NO: 44804 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttgaagtacatgaagtttt

SEQ ID NO: 44805 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtacatgaagtttttagtg

SEQ ID NO: 44806 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaagtttttagtgtggtttt

SEQ ID NO: 44807 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aagtttttagtgtggttttt

SEQ ID NO: 44808 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agtttttagtgtggtttttg

SEQ ID NO: 44809 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtttttagtgtggtttttgg

SEQ ID NO: 44810 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttgggggactcaatattta

SEQ ID NO: 44811 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgggggactcaatatttat

SEQ ID NO: 44812 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgggggactcaatatttata

SEQ ID NO: 44813 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gggggactcaatatttatag

SEQ ID NO: 44814 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggggactcaatatttatagg

SEQ ID NO: 44815 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gggggccaaaaatatttcat

SEQ ID NO: 44816 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatatttcatgagtgtaatt

SEQ ID NO: 44817 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atatttcatgagtgtaattt

SEQ ID NO: 44818 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atttcatgagtgtaatttag

SEQ ID NO: 44819 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttcatgagtgtaatttagga

SEQ ID NO: 44820 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctctatgcctattataattc

SEQ ID NO: 44821 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tctatgcctattataattct

SEQ ID NO: 44822 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgcctattataattctggg

SEQ ID NO: 44823 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcctattataattctgggca

SEQ ID NO: 44824 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctattataattctgggcaga

SEQ ID NO: 44825 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taattctgggcagagagtca

SEQ ID NO: 44826 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctctactatgcacaaataa

SEQ ID NO: 44827 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgaataaaatatctgtgtt

SEQ ID NO: 44828 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacataatatttatgtaatt

SEQ ID NO: 44829 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatttatgtaattaagaaat

SEQ ID NO: 44830 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aattaagaaataagattata

SEQ ID NO: 44831 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attaagaaataagattatac

SEQ ID NO: 44832 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagaaataagattatacagg

SEQ ID NO: 44833 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagattatacaggtagaatg

SEQ ID NO: 44834 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttatgcctttgtattatgtt

SEQ ID NO: 44835 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttgagccacatgaaatttc

SEQ ID NO: 44836 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catgaaatttctagtttttg

SEQ ID NO: 44837 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagtttttgcagattaaaaa

SEQ ID NO: 44838 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttttgcagattaaaaatggt

SEQ ID NO: 44839 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attaaaaatggttggatatt

SEQ ID NO: 44840 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatatattttctaattcaat

SEQ ID NO: 44841 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaaattaacttttgttttt

SEQ ID NO: 44842 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attttatacaatatgtttca

SEQ ID NO: 44843 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atattattccaaattatgcc

SEQ ID NO: 44844 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtaactgcatctcttaaaa

SEQ ID NO: 44845 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attcttttgacattttcata

SEQ ID NO: 44846 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttcttttgacattttcataa

SEQ ID NO: 44847 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cataaaggaataataataat

SEQ ID NO: 44848 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaggaataataataattag

SEQ ID NO: 44849 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggaataataataattagtag

SEQ ID NO: 44850 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ataataataattagtagcag

SEQ ID NO: 44851 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attagtagcagtagtaatat

SEQ ID NO: 44852 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tagtagcagtagtaatattg

SEQ ID NO: 44853 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagcagtagtaatattggag

SEQ ID NO: 44854 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaccttgttaataccttcc

SEQ ID NO: 44855 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaccttgttaataccttcca

SEQ ID NO: 44856 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
accttccaaggtatcttacc

SEQ ID NO: 44857 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cttccaaggtatcttaccaa

SEQ ID NO: 44858 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggtatcttaccaagagaatc

SEQ ID NO: 44859 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagagaatccagattttatt

SEQ ID NO: 44860 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agagaatccagattttattc

SEQ ID NO: 44861 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gagaatccagattttattca

SEQ ID NO: 44862 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatccagattttattcaggg

SEQ ID NO: 44863 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attcagggtagcaatatgcc

SEQ ID NO: 44864 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cccagataaatgtcctgcct

SEQ ID NO: 44865 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gataaatgtcctgcctcagc

SEQ ID NO: 44866 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ataaatgtcctgcctcagcc

SEQ ID NO: 44867 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagccaggctaccttgttgt

SEQ ID NO: 44868 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agccaggctaccttgttgtt

SEQ ID NO: 44869 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gccaggctaccttgttgtta

SEQ ID NO: 44870 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccaggctaccttgttgttag

SEQ ID NO: 44871 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggctaccttgttgttagggg

SEQ ID NO: 44872 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtcacactgttcttgccaat

SEQ ID NO: 44873 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgttcttgccaataagacat

SEQ ID NO: 44874 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgccaataagacataagcca

SEQ ID NO: 44875 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aataagacataagccaaagt

SEQ ID NO: 44876 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gacataagccaaagttggat

SEQ ID NO: 44877 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acataagccaaagttggata

SEQ ID NO: 44878 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caaagttggataaggatctc

SEQ ID NO: 44879 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaagttggataaggatctct

SEQ ID NO: 44880 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttggataaggatctctggga

SEQ ID NO: 44881 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gggaaagttttgcccttcct

SEQ ID NO: 44882 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggaaagttttgcccttcctc

SEQ ID NO: 44883 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agttttgcccttcctcaggc

SEQ ID NO: 44884 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttgcccttcctcaggcaag

SEQ ID NO: 44885 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttgcccttcctcaggcaagt

SEQ ID NO: 44886 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccttcctcaggcaagtggga

SEQ ID NO: 44887 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gttctatttctttctctacc

SEQ ID NO: 44888 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttctatttctttctctacct

SEQ ID NO: 44889 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttctttctctacctgggtat

SEQ ID NO: 44890 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctacctgggtattggatata

SEQ ID NO: 44891 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gggtattggatataaagctg

SEQ ID NO: 44892 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggtattggatataaagctgt

SEQ ID NO: 44893 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attggatataaagctgtagg

SEQ ID NO: 44894 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atataaagctgtaggtggaa

SEQ ID NO: 44895 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggaacagtcacctctaatca

SEQ ID NO: 44896 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaacagtcacctctaatcat

SEQ ID NO: 44897 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctaatcataggcattaata

SEQ ID NO: 44898 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatcataggcattaatatag

SEQ ID NO: 44899 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagaagaaaaaacacatgtg

SEQ ID NO: 44900 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaaaaaacacatgtgaagat

SEQ ID NO: 44901 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaacacatgtgaagattgg

SEQ ID NO: 44902 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acacatgtgaagattggcag

SEQ ID NO: 44903 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cacatgtgaagattggcaga

SEQ ID NO: 44904 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acatgtgaagattggcagaa

SEQ ID NO: 44905 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgtgaagattggcagaagg

SEQ ID NO: 44906 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaagattggcagaagggag

SEQ ID NO: 44907 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagattggcagaagggagaa

SEQ ID NO: 44908 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttggcagaagggagaagaga

SEQ ID NO: 44909 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggcagaagggagaagagatg

SEQ ID NO: 44910 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagggagaagagatggagcc

SEQ ID NO: 44911 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agggagaagagatggagcct

SEQ ID NO: 44912 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagagatggagcctaggaca

SEQ ID NO: 44913 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gagatggagcctaggacatg

SEQ ID NO: 44914 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agatggagcctaggacatgg

SEQ ID NO: 44915 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cctaggacatggaggccacg

SEQ ID NO: 44916 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccacgtggactgctgatctg

SEQ ID NO: 44917 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gatgttttaaaatatgaaaa

SEQ ID NO: 44918 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgaaaacagaatgttctatc

SEQ ID NO: 44919 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctatccagttatgccaatg

SEQ ID NO: 44920 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccagttatgccaatgtagtt

SEQ ID NO: 44921 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agttaagtctctgttgcatg

SEQ ID NO: 44922 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctctgttgcatgcagttaaa

SEQ ID NO: 44923 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgttgcatgcagttaaaca

SEQ ID NO: 44924 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agttaaacagagtcctgact

SEQ ID NO: 44925 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acagagtcctgactcagaaa

SEQ ID NO: 44926 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaacacacacacaaaaaaa

SEQ ID NO: 44927 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaacacacacacaaaaaaat

SEQ ID NO: 44928 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aacacacacacaaaaaaata

SEQ ID NO: 44929 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gggattacccatgtaccctt

SEQ ID NO: 44930 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccatgtacccttaagtaaaa

SEQ ID NO: 44931 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catgtacccttaagtaaaat

SEQ ID NO: 44932 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtaaaataggtttattcaaa

SEQ ID NO: 44933 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataggtttattcaaatagtt

SEQ ID NO: 44934 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agatcttaacatgtgtacct

SEQ ID NO: 44935 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttaacatgtgtaccttggtg

SEQ ID NO: 44936 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acatgtgtaccttggtgtgg

SEQ ID NO: 44937 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgtaccttggtgtggcagt

SEQ ID NO: 44938 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtggcagtaagtgtactccc

SEQ ID NO: 44939 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtactccctagcccctaata

SEQ ID NO: 44940 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctaatatagccttaatgtga

SEQ ID NO: 44941 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctacttaatacattgtcct

SEQ ID NO: 44942 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tacttaatacattgtcctga

SEQ ID NO: 44943 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cattgtcctgagagaacaca

SEQ ID NO: 44944 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attgtcctgagagaacacaa

SEQ ID NO: 44945 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgagagaacacaaaggttca

SEQ ID NO: 44946 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agagaacacaaaggttcaaa

SEQ ID NO: 44947 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaacacaaaggttcaaaga

SEQ ID NO: 44948 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acaaaggttcaaagagagca

SEQ ID NO: 44949 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaagagagcaaagtgatgtg

SEQ ID NO: 44950 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttttctgtaataacataat

SEQ ID NO: 44951 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taacataataagtcatgaca

SEQ ID NO: 44952 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aacataataagtcatgacaa

SEQ ID NO: 44953 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cataataagtcatgacaaag

SEQ ID NO: 44954 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgacaaaggagatgcttta

SEQ ID NO: 44955 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgacaaaggagatgctttaa

SEQ ID NO: 44956 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgctttaaaggcaatgatc

SEQ ID NO: 44957 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaggcaatgatctggactt

SEQ ID NO: 44958 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggactttagtgatatttct

SEQ ID NO: 44959 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cacttgccaatttcatcaac

SEQ ID NO: 44960 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgccaatttcatcaacaagc

SEQ ID NO: 44961 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gccaatttcatcaacaagcc

SEQ ID NO: 44962 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccaatttcatcaacaagcca

SEQ ID NO: 44963 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatttcatcaacaagccagg

SEQ ID NO: 44964 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttcatcaacaagccaggga

SEQ ID NO: 44965 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atcaacaagccagggagagc

SEQ ID NO: 44966 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caagccagggagagctggat

SEQ ID NO: 44967 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agggagagctggataagtct

SEQ ID NO: 44968 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagagctggataagtcttag

SEQ ID NO: 44969 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggataagtcttagtagcact

SEQ ID NO: 44970 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tagtagcactaagaacctca

SEQ ID NO: 44971 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taagaacctcatagttacct

SEQ ID NO: 44972 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacctcatagttacctcagc

SEQ ID NO: 44973 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acctcatagttacctcagca

SEQ ID NO: 44974 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acctcagcaaggttttcacc

SEQ ID NO: 44975 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctcagcaaggttttcaccta

SEQ ID NO: 44976 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcaaggttttcacctagag

SEQ ID NO: 44977 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctagagaagaatgaatgtat

SEQ ID NO: 44978 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tagagaagaatgaatgtatc

SEQ ID NO: 44979 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaagaatgaatgtatcagg

SEQ ID NO: 44980 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaatgaatgtatcaggcag

SEQ ID NO: 44981 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgtatcaggcagaagctac

SEQ ID NO: 44982 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagctacaagaacttgaatt

SEQ ID NO: 44983 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acaagaacttgaatttggtc

SEQ ID NO: 44984 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aacttgaatttggtctagat

SEQ ID NO: 44985 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caataatttgcatgaaaaaa

SEQ ID NO: 44986 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatatgcaaaaataaatata

SEQ ID NO: 44987 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgcatttaatactgaataaa

SEQ ID NO: 44988 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttaatactgaataaatgga

SEQ ID NO: 44989 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttaatactgaataaatggaa

SEQ ID NO: 44990 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tactgaataaatggaaagga

SEQ ID NO: 44991 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actgaataaatggaaaggaa

SEQ ID NO: 44992 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctgaataaatggaaaggaaa

SEQ ID NO: 44993 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atggaaaggaaagggttatg

SEQ ID NO: 44994 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggaaagggttatgtagtctt

SEQ ID NO: 44995 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agggttatgtagtcttgaga

SEQ ID NO: 44996 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttgagaaagaaatatattc

SEQ ID NO: 44997 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagaaagaaatatattctag

SEQ ID NO: 44998 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atatattctagaagtaaaat

SEQ ID NO: 44999 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atcagttttacttttcaata

SEQ ID NO: 45000 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agttttacttttcaataaag

SEQ ID NO: 45001 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gttttacttttcaataaaga

SEQ ID NO: 45002 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttttacttttcaataaagaa

SEQ ID NO: 45003 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttcaataaagaagggaat

SEQ ID NO: 45004 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caataaagaagggaataaga

SEQ ID NO: 45005 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagggaataagatagttttg

SEQ ID NO: 45006 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaatcacacattattacc

SEQ ID NO: 45007 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaatcacacattattacca

SEQ ID NO: 45008 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atcacacattattaccaagg

SEQ ID NO: 45009 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaggtagactataacctaat

SEQ ID NO: 45010 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tagactataacctaatcagt

SEQ ID NO: 45011 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taacctaatcagtcagcatt

SEQ ID NO: 45012 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aacctaatcagtcagcatta

SEQ ID NO: 45013 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctaatcagtcagcattaagg

SEQ ID NO: 45014 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagtcagcattaaggtggat

SEQ ID NO: 45015 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcagcattaaggtggattag

SEQ ID NO: 45016 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtggattagaagcacaatat

SEQ ID NO: 45017 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atatcagaatcccaatgaat

SEQ ID NO: 45018 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatgtacaataccattacaa

SEQ ID NO: 45019 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caccctgaattacaccatta

SEQ ID NO: 45020 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccctgaattacaccattaca

SEQ ID NO: 45021 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cctgaattacaccattacag

SEQ ID NO: 45022 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attacaccattacagaggta

SEQ ID NO: 45023 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acaccattacagaggtatag

SEQ ID NO: 45024 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctcattttcttgcctttcta

SEQ ID NO: 45025 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcttgcctttctatggcatg

SEQ ID NO: 45026 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggcatgtagtataatgatta

SEQ ID NO: 45027 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtagtataatgattacagct

SEQ ID NO: 45028 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tagtataatgattacagctt

SEQ ID NO: 45029 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agtataatgattacagcttg

SEQ ID NO: 45030 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcttggggtttaaatttaaa

SEQ ID NO: 45031 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttaaatttaaaaagacccc

SEQ ID NO: 45032 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caaatcttttcttaatcttt

SEQ ID NO: 45033 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcttaatcttttagaatcg

SEQ ID NO: 45034 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atcgcagtcatctgcaaata

SEQ ID NO: 45035 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgcattatatttacttcct

SEQ ID NO: 45036 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgcattatatttacttccta

SEQ ID NO: 45037 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cattatatttacttcctaag

SEQ ID NO: 45038 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attatatttacttcctaagg

SEQ ID NO: 45039 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacttcctaaggaggtcaca

SEQ ID NO: 45040 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaattatataatgtgtgta

SEQ ID NO: 45041 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaattatataatgtgtgtaa

SEQ ID NO: 45042 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aattatataatgtgtgtaaa

SEQ ID NO: 45043 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
attatataatgtgtgtaaag

SEQ ID NO: 45044 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtgtttgatccgctgttct

SEQ ID NO: 45045 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctgttctcagctgctgtctg

SEQ ID NO: 45046 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgtctgtggttctgtcatg

SEQ ID NO: 45047 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctgtggttctgtcatgaag

SEQ ID NO: 45048 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtcatgaagtagatgctct

SEQ ID NO: 45049 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtcatgaagtagatgctcta

SEQ ID NO: 45050 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actgtccacatcctgctttc

SEQ ID NO: 45051 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tccacatcctgctttccagc

SEQ ID NO: 45052 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagcaagctgctcattcccc

SEQ ID NO: 45053 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctcattcccccagctgccaa

SEQ ID NO: 45054 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cccccagctgccaaaagtgt

SEQ ID NO: 45055 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gccaaaagtgttggatgctg

SEQ ID NO: 45056 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccaaaagtgttggatgctga

SEQ ID NO: 45057 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctcacatctgaatccctctt

SEQ ID NO: 45058 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcacatctgaatccctcttt

SEQ ID NO: 45059 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tccctctttgggccttatcg

SEQ ID NO: 45060 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctctttgggccttatcgtgg

SEQ ID NO: 45061 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttgggccttatcgtggcag

SEQ ID NO: 45062 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgggccttatcgtggcaga

SEQ ID NO: 45063 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgggccttatcgtggcagaa

SEQ ID NO: 45064 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggccttatcgtggcagaagg

SEQ ID NO: 45065 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gccttatcgtggcagaaggg

SEQ ID NO: 45066 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaagggaggtgcttccccc

SEQ ID NO: 45067 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaagggaggtgcttccccca

SEQ ID NO: 45068 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaggttatacccttctcccc

SEQ ID NO: 45069 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatacccttctcccctgga

SEQ ID NO: 45070 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatacccttctcccctggaa

SEQ ID NO: 45071 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccttctcccctggaaaggta

SEQ ID NO: 45072 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttctcccctggaaaggtaa

SEQ ID NO: 45073 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttctcccctggaaaggtaaa

SEQ ID NO: 45074 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctcccctggaaaggtaaagg

SEQ ID NO: 45075 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cccctggaaaggtaaaggga

SEQ ID NO: 45076 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gagagcctgcatccaatgaa

SEQ ID NO: 45077 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cctgcatccaatgaatggtg

SEQ ID NO: 45078 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgcatccaatgaatggtgtg

SEQ ID NO: 45079 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atccaatgaatggtgtggag

SEQ ID NO: 45080 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgaatggtgtggagaaga

SEQ ID NO: 45081 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgaatggtgtggagaagaa

SEQ ID NO: 45082 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctgaccctcttgctttgttt

SEQ ID NO: 45083 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gctttgttttggaactactc

SEQ ID NO: 45084 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttgttttggaactactcca

SEQ ID NO: 45085 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgttttggaactactccag

SEQ ID NO: 45086 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgttttggaactactccaga

SEQ ID NO: 45087 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actactccagagggttgtca

SEQ ID NO: 45088 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccagagggttgtcacagcat

SEQ ID NO: 45089 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agagggttgtcacagcatca

SEQ ID NO: 45090 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cacagcatcagagatgccaa

SEQ ID NO: 45091 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acagcatcagagatgccaat

SEQ ID NO: 45092 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atcagagatgccaataggat

SEQ ID NO: 45093 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatctctgttgcaattttaa

SEQ ID NO: 45094 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttgcatgcctcacttttta

SEQ ID NO: 45095 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcgttcctgaaaacacttct

SEQ ID NO: 45096 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaacacttctcagtaaatct

SEQ ID NO: 45097 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaatctcagatttctctct

SEQ ID NO: 45098 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaatctcagatttctctctc

SEQ ID NO: 45099 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcagatttctctctcaggat

SEQ ID NO: 45100 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctctctcaggattggtttcc

SEQ ID NO: 45101 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctctcaggattggtttccc

SEQ ID NO: 45102 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctctcaggattggtttccca

SEQ ID NO: 45103 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cacaatcccgtgattaatga

SEQ ID NO: 45104 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atcccgtgattaatgaaagt

SEQ ID NO: 45105 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgacttttcttctttcctt

SEQ ID NO: 45106 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctttccatatacctcctgtt

SEQ ID NO: 45107 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttccatatacctcctgttc

SEQ ID NO: 45108 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggttcactgcctgtactgc

SEQ ID NO: 45109 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttcactgcctgtactgcaag

SEQ ID NO: 45110 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcctcaattttctcctccat

SEQ ID NO: 45111 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taattgtatcaataaccatc

SEQ ID NO: 45112 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caataaccatctagtcttct

SEQ ID NO: 45113 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taagtcaaaattctttgttg

SEQ ID NO: 45114 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aagtcaaaattctttgttgt

SEQ ID NO: 45115 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttgaattgtaatcctccaa

SEQ ID NO: 45116 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atcctccaaaagttatgttg

SEQ ID NO: 45117 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttatgttgaagtcctaaccc

SEQ ID NO: 45118 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtcctaaccctggcatgttt

SEQ ID NO: 45119 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtttgagtgtgatcttatt

SEQ ID NO: 45120 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtgatcttatttggaaata

SEQ ID NO: 45121 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atttggaaatatggtctttg

SEQ ID NO: 45122 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggtctttgcagacacaatg

SEQ ID NO: 45123 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttgcagacacaatgaagat

SEQ ID NO: 45124 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgcagacacaatgaagatg

SEQ ID NO: 45125 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgaagatgaggtcattgtg

SEQ ID NO: 45126 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgaagatgaggtcattgtgt

SEQ ID NO: 45127 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gggtccaaatccaatataac

SEQ ID NO: 45128 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggtccaaatccaatataact

SEQ ID NO: 45129 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtccaaatccaatataactg

SEQ ID NO: 45130 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatataactggggtccttat

SEQ ID NO: 45131 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataactggggtccttataag

SEQ ID NO: 45132 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggggtccttataagaagaa

SEQ ID NO: 45133 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccttataagaagaaaagacc

SEQ ID NO: 45134 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaagaaaagaccgagacaca

SEQ ID NO: 45135 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagaaaagaccgagacacac

SEQ ID NO: 45136 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agaaaagaccgagacacaca

SEQ ID NO: 45137 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaagaccgagacacacagg

SEQ ID NO: 45138 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acacagggagaaaactacgt

SEQ ID NO: 45139 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ggagaaaactacgtgagtac

SEQ ID NO: 45140 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gagaaaactacgtgagtacc

SEQ ID NO: 45141 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaactacgtgagtaccgggc

SEQ ID NO: 45142 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
actacgtgagtaccgggcca

SEQ ID NO: 45143 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtgagtaccgggccagagat

SEQ ID NO: 45144 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgagtaccgggccagagatt

SEQ ID NO: 45145 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggccagagattgggatgatg

SEQ ID NO: 45146 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gattgggatgatgcagctgc

SEQ ID NO: 45147 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgatgcagctgcaagctgc

SEQ ID NO: 45148 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgatgcagctgcaagctgca

SEQ ID NO: 45149 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggattgccaacaacctcca

SEQ ID NO: 45150 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgccaacaacctccaaagt

SEQ ID NO: 45151 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caacaacctccaaagttaga

SEQ ID NO: 45152 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caacctccaaagttagaaag

SEQ ID NO: 45153 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctccaaagttagaaagcagc

SEQ ID NO: 45154 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tccaaagttagaaagcagca

SEQ ID NO: 45155 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaagttagaaagcagcaagg

SEQ ID NO: 45156 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagttagaaagcagcaaggc

SEQ ID NO: 45157 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagcaaggcaggatacttac

SEQ ID NO: 45158 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcaaggcaggatacttacta

SEQ ID NO: 45159 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aggatacttactagagcctt

SEQ ID NO: 45160 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gatacttactagagccttta

SEQ ID NO: 45161 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagagcctttagagaaatca

SEQ ID NO: 45162 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agagaaatcatggccttgct

SEQ ID NO: 45163 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccttgctcagaccttgattt

SEQ ID NO: 45164 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agaccttgatttcagacttc

SEQ ID NO: 45165 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gatttcagacttctagcctc

SEQ ID NO: 45166 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agacttctagcctccagaac

SEQ ID NO: 45167 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctagcctccagaactggcaa

SEQ ID NO: 45168 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaataaatttctgttgttgt

SEQ ID NO: 45169 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttctgttgttgtaagccact

SEQ ID NO: 45170 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttttgctaatttgttacaa

SEQ ID NO: 45171 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taatttgttacaacagccgt

SEQ ID NO: 45172 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtaagaaactaatacatcct

SEQ ID NO: 45173 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaactaatacatccttggat

SEQ ID NO: 45174 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agctcacaatcttatatatc

SEQ ID NO: 45175 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atcttatatatctagaccct

SEQ ID NO: 45176 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcccttatattttaactttc

SEQ ID NO: 45177 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atcccgatattaaattgttg

SEQ ID NO: 45178 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttaaattgttgcagctgtgt

SEQ ID NO: 45179 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaacatgatcttttttccct

SEQ ID NO: 45180 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttttccctcagcaattct

SEQ ID NO: 45181 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tccctcagcaattcttagca

SEQ ID NO: 45182 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcaattcttagcacagtgct

SEQ ID NO: 45183 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aattcttagcacagtgctta

SEQ ID NO: 45184 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttagcacagtgcttagagca

SEQ ID NO: 45185 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cacagtgcttagagcatagt

SEQ ID NO: 45186 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acagtgcttagagcatagta

SEQ ID NO: 45187 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aataaatatttattgacaaa

SEQ ID NO: 45188 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ataaatatttattgacaaat

SEQ ID NO: 45189 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgcatttcatacttccttt

SEQ ID NO: 45190 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgcatttcatacttccttta

SEQ ID NO: 45191 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cttcctttaaggcttctaat

SEQ ID NO: 45192 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttcctttaaggcttctaatg

SEQ ID NO: 45193 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctttaaggcttctaatgagg

SEQ ID NO: 45194 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgaggaagcacttcactgc

SEQ ID NO: 45195 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aggaagcacttcactgccag

SEQ ID NO: 45196 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttcactgccagtggtaaaa

SEQ ID NO: 45197 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagtggtaaaaaagcctgtg

SEQ ID NO: 45198 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtagtgtgttgttaatgtt

SEQ ID NO: 45199 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tagtgtgttgttaatgtttg

SEQ ID NO: 45200 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gttaatgtttggagtgtgct

SEQ ID NO: 45201 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taatgtttggagtgtgcttg

SEQ ID NO: 45202 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatgtttggagtgtgcttgg

SEQ ID NO: 45203 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgtttggagtgtgcttgga

SEQ ID NO: 45204 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tggagggcttcattgcactt

SEQ ID NO: 45205 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggagggcttcattgcacttc

SEQ ID NO: 45206 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agggcttcattgcacttcag

SEQ ID NO: 45207 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcttcattgcacttcaggag

SEQ ID NO: 45208 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttcattgcacttcaggaga

SEQ ID NO: 45209 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttcaggagaaggctgactct

SEQ ID NO: 45210 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggagaaggctgactctgag

SEQ ID NO: 45211 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gagaaggctgactctgagaa

SEQ ID NO: 45212 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgactctgagaagagccat

SEQ ID NO: 45213 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctgagaagagccatcagtt

SEQ ID NO: 45214 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagttcagtgcctgcattct

SEQ ID NO: 45215 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtgcctgcattcttagaaa

SEQ ID NO: 45216 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcattcttagaaacagtgaa

SEQ ID NO: 45217 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attcttagaaacagtgaaaa

SEQ ID NO: 45218 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgaaaagagtattattctca

SEQ ID NO: 45219 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaaaagagtattattctcat

SEQ ID NO: 45220 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttattctcatgggtaccttt

SEQ ID NO: 45221 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catgggtacctttgagataa

SEQ ID NO: 45222 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctgacactgactatctctt

SEQ ID NO: 45223 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgacactgactatctcttca

SEQ ID NO: 45224 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cactgactatctcttcagag

SEQ ID NO: 45225 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctatttccatttgtttcct

SEQ ID NO: 45226 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgtttcctcagaactgttt

SEQ ID NO: 45227 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttgttttaactcatctctt

SEQ ID NO: 45228 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctctttggttattttctgat

SEQ ID NO: 45229 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctttggttattttctgataa

SEQ ID NO: 45230 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttggttattttctgataag

SEQ ID NO: 45231 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaatattttgatttgattc

SEQ ID NO: 45232 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatattttgatttgattctg

SEQ ID NO: 45233 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtgtatttttaactgtctat

SEQ ID NO: 45234 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtatttttaactgtctatc

SEQ ID NO: 45235 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttttaactgtctatcaggtt

SEQ ID NO: 45236 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttaactgtctatcaggttg

SEQ ID NO: 45237 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtcaacctgaaaacttatac

SEQ ID NO: 45238 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcaacctgaaaacttatact

SEQ ID NO: 45239 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aacctgaaaacttatactag

SEQ ID NO: 45240 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cctgaaaacttatactagga

SEQ ID NO: 45241 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aattctccataaactctgtt

SEQ ID NO: 45242 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cataaactctgttgagaaac

SEQ ID NO: 45243 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ataaactctgttgagaaacc

SEQ ID NO: 45244 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgttgagaaaccaggatgc

SEQ ID NO: 45245 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgttgagaaaccaggatgct

SEQ ID NO: 45246 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
accaggatgctaggtcataa

SEQ ID NO: 45247 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caggatgctaggtcataaaa

SEQ ID NO: 45248 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggatgctaggtcataaaaga

SEQ ID NO: 45249 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gatgctaggtcataaaagag

SEQ ID NO: 45250 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgctaggtcataaaagaga

SEQ ID NO: 45251 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtcataaaagagagggtttt

SEQ ID NO: 45252 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcataaaagagagggttttt

SEQ ID NO: 45253 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaaagagagggtttttggg

SEQ ID NO: 45254 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaagagagggtttttgggt

SEQ ID NO: 45255 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaagagagggtttttgggta

SEQ ID NO: 45256 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agagagggtttttgggtagg

SEQ ID NO: 45257 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagggtttttgggtagggag

SEQ ID NO: 45258 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gggtttttgggtagggagaa

SEQ ID NO: 45259 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtttttgggtagggagaaga

SEQ ID NO: 45260 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttttgggtagggagaagag

SEQ ID NO: 45261 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttttgggtagggagaagaga

SEQ ID NO: 45262 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgggtagggagaagagagg

SEQ ID NO: 45263 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gggtagggagaagagaggga

SEQ ID NO: 45264 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaagagagggagagatatca

SEQ ID NO: 45265 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagagagggagagatatcaa

SEQ ID NO: 45266 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagggagagatatcaaaggt

SEQ ID NO: 45267 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttttccccttgctcaaaatg

SEQ ID NO: 45268 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttccccttgctcaaaatgc

SEQ ID NO: 45269 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaaatgcaggttcttaaac

SEQ ID NO: 45270 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcaggttcttaaacaagcaa

SEQ ID NO: 45271 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caggttcttaaacaagcaaa

SEQ ID NO: 45272 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aggttcttaaacaagcaaaa

SEQ ID NO: 45273 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggttcttaaacaagcaaaag

SEQ ID NO: 45274 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caaaaggggaaatataccca

SEQ ID NO: 45275 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atacccatagcccctgaata

SEQ ID NO: 45276 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaataaagaaaataatatct

SEQ ID NO: 45277 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatctcagaaacctgaatcc

SEQ ID NO: 45278 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcagaaacctgaatccaagt

SEQ ID NO: 45279 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaacctgaatccaagtaagc

SEQ ID NO: 45280 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aacctgaatccaagtaagct

SEQ ID NO: 45281 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acctgaatccaagtaagcta

SEQ ID NO: 45282 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atccaagtaagctagggatt

SEQ ID NO: 45283 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagtaagctagggattaagt

SEQ ID NO: 45284 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ataataattgtacatattta

SEQ ID NO: 45285 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taataattgtacatatttat

SEQ ID NO: 45286 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aataattgtacatatttatg

SEQ ID NO: 45287 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatttatggggtacatgtga

SEQ ID NO: 45288 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacattatataattatcaaa

SEQ ID NO: 45289 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acattatataattatcaaat

SEQ ID NO: 45290 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cattatataattatcaaata

SEQ ID NO: 45291 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taattatcaaatagggtaac

SEQ ID NO: 45292 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttatcaaatagggtaactag

SEQ ID NO: 45293 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tagggtaactagcagatcca

SEQ ID NO: 45294 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aacatttaccatttctttgt

SEQ ID NO: 45295 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acatttaccatttctttgtg

SEQ ID NO: 45296 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atttaccatttctttgtgag

SEQ ID NO: 45297 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggagaccatttaaaaacttc

SEQ ID NO: 45298 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgaaatatacaacacatta

SEQ ID NO: 45299 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caacacattatggttaactc

SEQ ID NO: 45300 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctagtcatccaacgattcaa

SEQ ID NO: 45301 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccaacgattcaatagaacac

SEQ ID NO: 45302 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttattctttctatctcactg

SEQ ID NO: 45303 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tccccacacctcgctcctcc

SEQ ID NO: 45304 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctacttctatgacaaccctt

SEQ ID NO: 45305 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttagattccacatatgtgt

SEQ ID NO: 45306 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gatatttgactttctgtgcc

SEQ ID NO: 45307 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcacttaacataatgtcctc

SEQ ID NO: 45308 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cacttaacataatgtcctcc

SEQ ID NO: 45309 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attcatgttgccacaaataa

SEQ ID NO: 45310 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttcatgttgccacaaataac

SEQ ID NO: 45311 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caggatttcattatttctta

SEQ ID NO: 45312 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cattatttcttatggctgaa

SEQ ID NO: 45313 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttatttatttacgatcatt

SEQ ID NO: 45314 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttatttatttacgatcattt

SEQ ID NO: 45315 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttaggttaatatgataact

SEQ ID NO: 45316 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gataacttggctattgtgaa

SEQ ID NO: 45317 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttggctattgtgaacagtg

SEQ ID NO: 45318 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acagtgcagcaataaacata

SEQ ID NO: 45319 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagtgcagcaataaacatat

SEQ ID NO: 45320 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtgcagcaataaacatatag

SEQ ID NO: 45321 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcaataaacatataggagta

SEQ ID NO: 45322 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catactgatttcatttcatc

SEQ ID NO: 45323 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atttcatctggatatttact

SEQ ID NO: 45324 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctggatatttacttagtat

SEQ ID NO: 45325 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctggatatttacttagtatt

SEQ ID NO: 45326 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttacttagtattgggactgc

SEQ ID NO: 45327 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attctatttttaatttttta

SEQ ID NO: 45328 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccccatattactttccataa

SEQ ID NO: 45329 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catattactttccataatgg

SEQ ID NO: 45330 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctaatttacattctcacaat

SEQ ID NO: 45331 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cattctcacaatcagtgtgt

SEQ ID NO: 45332 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attctcacaatcagtgtgta

SEQ ID NO: 45333 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatatcttttgattttttga

SEQ ID NO: 45334 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atcttttgattttttgatgg

SEQ ID NO: 45335 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgatggtagccattttaac

SEQ ID NO: 45336 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgatggtagccattttaact

SEQ ID NO: 45337 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gatggtagccattttaacta

SEQ ID NO: 45338 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtagccattttaactagggt

SEQ ID NO: 45339 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tagccattttaactagggtg

SEQ ID NO: 45340 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gccattttaactagggtgag

SEQ ID NO: 45341 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctagggtgaggagatacctc

SEQ ID NO: 45342 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggtgaggagatacctcaaga

SEQ ID NO: 45343 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtgaggagatacctcaagat

SEQ ID NO: 45344 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aggtttgatttgcatttccc

SEQ ID NO: 45345 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atttgcatttccctggtgat

SEQ ID NO: 45346 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccctggtgattagtgatgtt

SEQ ID NO: 45347 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcatattttcatttatctgt

SEQ ID NO: 45348 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcatttctttgtcttctttt

SEQ ID NO: 45349 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcttttgagaaatatctatt

SEQ ID NO: 45350 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttttgagaaatatctattc

SEQ ID NO: 45351 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgttttttttgtcgttgtt

SEQ ID NO: 45352 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgtcgttgttgagttgttt

SEQ ID NO: 45353 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttgagttccttgtatgttt

SEQ ID NO: 45354 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttagatattaacccattat

SEQ ID NO: 45355 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttaacccattatcagatgca

SEQ ID NO: 45356 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatttattttcccattctg

SEQ ID NO: 45357 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatttattttcccattctgt

SEQ ID NO: 45358 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgattgtttgccttgctgtg

SEQ ID NO: 45359 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgtttgccttgctgtgcag

SEQ ID NO: 45360 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttgctgtgcagaagctttt

SEQ ID NO: 45361 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttttgttgcctgtgctttt

SEQ ID NO: 45362 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttttgttgcctgtgcttttt

SEQ ID NO: 45363 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatccaaaaaaatccttgcc

SEQ ID NO: 45364 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgcctagaacaacatcatg

SEQ ID NO: 45365 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgttttttttcttctctaa

SEQ ID NO: 45366 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttcttctctaatagttgtg

SEQ ID NO: 45367 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctaatagttgtgtagtttt

SEQ ID NO: 45368 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagttttcagtcttacattt

SEQ ID NO: 45369 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttcagtcttacatttaag

SEQ ID NO: 45370 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acatttaagtagtctatttt

SEQ ID NO: 45371 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttgagttgacttgtgtata

SEQ ID NO: 45372 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agttgacttgtgtataaagt

SEQ ID NO: 45373 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgacttgtgtataaagtaa

SEQ ID NO: 45374 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtgtataaagtaagagata

SEQ ID NO: 45375 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtgtataaagtaagagataa

SEQ ID NO: 45376 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taatttcattcttttgcatg

SEQ ID NO: 45377 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcttttgcatgtggctatt

SEQ ID NO: 45378 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgtggctattcagtttgcc

SEQ ID NO: 45379 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgcccagaaccatttacta

SEQ ID NO: 45380 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcccagaaccatttactaaa

SEQ ID NO: 45381 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccagaaccatttactaaag

SEQ ID NO: 45382 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aggctgtcctttctctatta

SEQ ID NO: 45383 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggctgtcctttctctattat

SEQ ID NO: 45384 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctttctctattataggtact

SEQ ID NO: 45385 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttggaaccttgtcaaaact

SEQ ID NO: 45386 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctcagttgactgtatatgtg

SEQ ID NO: 45387 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatatgtgtagatttatttc

SEQ ID NO: 45388 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atatgtgtagatttatttct

SEQ ID NO: 45389 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctgtgtgtctgttttatgt

SEQ ID NO: 45390 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatgtcagtatcattctgtt

SEQ ID NO: 45391 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atcattctgtttggttacta

SEQ ID NO: 45392 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtttggttactatagcttta

SEQ ID NO: 45393 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagctttatagtatgttttg

SEQ ID NO: 45394 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttatagtatgttttgaagt

SEQ ID NO: 45395 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tagtatgttttgaagtcagt

SEQ ID NO: 45396 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttgaagtcagttagtgtg

SEQ ID NO: 45397 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtcagttagtgtgaagccat

SEQ ID NO: 45398 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagctttgttctttttgttc

SEQ ID NO: 45399 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agctttgttctttttgttcc

SEQ ID NO: 45400 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctttttgttccaggttact

SEQ ID NO: 45401 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctttttgttccaggttactt

SEQ ID NO: 45402 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tccaggttacttgggctatt

SEQ ID NO: 45403 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccaggttacttgggctattt

SEQ ID NO: 45404 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caggttacttgggctattta

SEQ ID NO: 45405 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gggctatttagggtcttttg

SEQ ID NO: 45406 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgtggtttcatacaaatgt

SEQ ID NO: 45407 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtggtttcatacaaatgtt

SEQ ID NO: 45408 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttttttttttttttctgta

SEQ ID NO: 45409 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttttctgtaaagaatgtcac

SEQ ID NO: 45410 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaatgtcactggtattttga

SEQ ID NO: 45411 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatgtcactggtattttgat

SEQ ID NO: 45412 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgtcactggtattttgata

SEQ ID NO: 45413 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tagggattgcattaaacctg

SEQ ID NO: 45414 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attaaacctgtagattgctt

SEQ ID NO: 45415 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttaaacctgtagattgcttt

SEQ ID NO: 45416 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtagattgctttgggtaata

SEQ ID NO: 45417 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attattctaatccatgaaca

SEQ ID NO: 45418 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttctctcaccaatatttta

SEQ ID NO: 45419 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tccttgtttaaatttatttc

SEQ ID NO: 45420 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccttgtttaaatttatttct

SEQ ID NO: 45421 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctaggtattttattttttg

SEQ ID NO: 45422 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttttttgtagctattgtaaa

SEQ ID NO: 45423 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttttgtagctattgtaaat

SEQ ID NO: 45424 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgggattgctttcttatttt

SEQ ID NO: 45425 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gattatttgttgttaacata

SEQ ID NO: 45426 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaatctactactttttttca

SEQ ID NO: 45427 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aatctactactttttttcat

SEQ ID NO: 45428 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atctactactttttttcatg

SEQ ID NO: 45429 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
actttttttcatggggtcat

SEQ ID NO: 45430 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cattagaactctctatatct

SEQ ID NO: 45431 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaactctctatatctaagat

SEQ ID NO: 45432 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatcagatcatataaaaaca

SEQ ID NO: 45433 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcagatcatataaaaacaaa

SEQ ID NO: 45434 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttctcttgcctgattgctc

SEQ ID NO: 45435 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcttgcctgattgctctggc

SEQ ID NO: 45436 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcattactatgttgaataa

SEQ ID NO: 45437 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attactatgttgaataaaag

SEQ ID NO: 45438 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgttgaataaaagtagtga

SEQ ID NO: 45439 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgaataaaagtagtgaaag

SEQ ID NO: 45440 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgaataaaagtagtgaaagt

SEQ ID NO: 45441 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgggcatccttatcttgttc

SEQ ID NO: 45442 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccttatcttgttccagatct

SEQ ID NO: 45443 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttatcttgttccagatcttg

SEQ ID NO: 45444 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atcttgttccagatcttgga

SEQ ID NO: 45445 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgttccagatcttggagaga

SEQ ID NO: 45446 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gatcttggagagaaagcttt

SEQ ID NO: 45447 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaaagctttcagctcttccc

SEQ ID NO: 45448 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gctttcagctcttccctggt

SEQ ID NO: 45449 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttccctggttagtatcatgt

SEQ ID NO: 45450 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggttagtatcatgttagctg

SEQ ID NO: 45451 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gttagtatcatgttagctgt

SEQ ID NO: 45452 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agctgtgggtttgttacata

SEQ ID NO: 45453 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catatggccttcattacatt

SEQ ID NO: 45454 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atatggccttcattacatta

SEQ ID NO: 45455 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgataatttttatcaaata

SEQ ID NO: 45456 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgataatttttatcaaataa

SEQ ID NO: 45457 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttttatcaaataaaggatac

SEQ ID NO: 45458 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgctttttctctgtctatt

SEQ ID NO: 45459 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtctattgagatgattata

SEQ ID NO: 45460 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttcattctgttgatataata

SEQ ID NO: 45461 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttctgttgatataatataga

SEQ ID NO: 45462 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgaaacatctttgcatccc

SEQ ID NO: 45463 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgaaacatctttgcatccct

SEQ ID NO: 45464 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgcatccctgggacgatttc

SEQ ID NO: 45465 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccctgggacgatttccagtt

SEQ ID NO: 45466 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggacgatttccagttgagca

SEQ ID NO: 45467 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atggtgaataatctttttga

SEQ ID NO: 45468 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggtgaataatctttttgat

SEQ ID NO: 45469 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taatctttttgataggctgt

SEQ ID NO: 45470 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttgataggctgttggattt

SEQ ID NO: 45471 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggctgttggatttgagttgc

SEQ ID NO: 45472 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgagttgctagtattttgt

SEQ ID NO: 45473 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgagttgctagtattttgtt

SEQ ID NO: 45474 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gagttgctagtattttgttg

SEQ ID NO: 45475 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cattttgcatctgtgttcat

SEQ ID NO: 45476 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attttgcatctgtgttcatc

SEQ ID NO: 45477 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttttgcatctgtgttcatca

SEQ ID NO: 45478 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcatctgtgttcatcaggga

SEQ ID NO: 45479 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctgtgttcatcagggatag

SEQ ID NO: 45480 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcatcagggatagtggcctt

SEQ ID NO: 45481 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtgtgtccctgtcttgttc

SEQ ID NO: 45482 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tccctgtcttgttctggtat

SEQ ID NO: 45483 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccctgtcttgttctggtatt

SEQ ID NO: 45484 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctgtcttgttctggtattg

SEQ ID NO: 45485 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttctggtattggggtaatat

SEQ ID NO: 45486 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttggggtaatattggccttg

SEQ ID NO: 45487 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttggccttgtagaatgaatt

SEQ ID NO: 45488 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gccttgtagaatgaatttag

SEQ ID NO: 45489 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcctttccttttgatttttt

SEQ ID NO: 45490 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgatttttttggaataattt

SEQ ID NO: 45491 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttttttggaataatttaag

SEQ ID NO: 45492 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tggaataatttaagaagaat

SEQ ID NO: 45493 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatttaagaagaattagtat

SEQ ID NO: 45494 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttagttcttctttaaatgtt

SEQ ID NO: 45495 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttcttctttaaatgtttgg

SEQ ID NO: 45496 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaatgtttggtagaattcat

SEQ ID NO: 45497 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttggtagaattcatcagtg

SEQ ID NO: 45498 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aattcatcagtgaagccatg

SEQ ID NO: 45499 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcagtgaagccatgtggtcc

SEQ ID NO: 45500 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggtcctggacttttctttgc

SEQ ID NO: 45501 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtcctggacttttctttgct

SEQ ID NO: 45502 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cctggacttttctttgctag

SEQ ID NO: 45503 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggacttttctttgctagga

SEQ ID NO: 45504 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcaatcttgttactcattat

SEQ ID NO: 45505 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tactcattattggtctgttt

SEQ ID NO: 45506 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttttccatttcttcatgata

SEQ ID NO: 45507 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atttcttcatgatacagtct

SEQ ID NO: 45508 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttcatgatacagtcttggc

SEQ ID NO: 45509 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cttggcaagttgtatgtgtt

SEQ ID NO: 45510 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtaatttatcaatttccat

SEQ ID NO: 45511 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtaatttatcaatttccatt

SEQ ID NO: 45512 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cattaggttttccaatttgt

SEQ ID NO: 45513 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttaggttttccaatttgttg

SEQ ID NO: 45514 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgttggagtatgattgttca

SEQ ID NO: 45515 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tggagtatgattgttcatag

SEQ ID NO: 45516 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcatagtagtctctattgat

SEQ ID NO: 45517 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tagtagtctctattgatcag

SEQ ID NO: 45518 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaacgttgttaatgattctg

SEQ ID NO: 45519 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctgaagttgcatccaaatt

SEQ ID NO: 45520 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctgaagttgcatccaaattt

SEQ ID NO: 45521 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatttaggcaaacaattca

SEQ ID NO: 45522 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatttaggcaaacaattcaa

SEQ ID NO: 45523 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acaattcaaaggatatgatc

SEQ ID NO: 45524 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcaaaggatatgatccagaa

SEQ ID NO: 45525 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caaaggatatgatccagaac

SEQ ID NO: 45526 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagaacaggcatttgtaata

SEQ ID NO: 45527 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcatttgtaataaagtcccc

SEQ ID NO: 45528 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttcacacactaaaattctg

SEQ ID NO: 45529 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaattcaatctgtaaccaa

SEQ ID NO: 45530 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgtaaccaatagctactta

SEQ ID NO: 45531 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gctacttacagtgtgtatat

SEQ ID NO: 45532 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acttataataattgtacatt

SEQ ID NO: 45533 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacattgagcacttttcaat

SEQ ID NO: 45534 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcatttgtctaattatttat

SEQ ID NO: 45535 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgtttttgtaaattgctc

SEQ ID NO: 45536 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgtttttgtaaattgctca

SEQ ID NO: 45537 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attgctcaaggtcttatcaa

SEQ ID NO: 45538 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcaaggtcttatcaaaagct

SEQ ID NO: 45539 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cttatcaaaagctaagattt

SEQ ID NO: 45540 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttatcaaaagctaagatttg

SEQ ID NO: 45541 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggcaaatattctatcttaaa

SEQ ID NO: 45542 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaatattctatcttaaaaag

SEQ ID NO: 45543 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggcattcttaactatatccc

SEQ ID NO: 45544 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcattcttaactatatccca

SEQ ID NO: 45545 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttcttaactatatcccaagg

SEQ ID NO: 45546 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttaactatatcccaaggtag

SEQ ID NO: 45547 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatatcccaaggtagtggct

SEQ ID NO: 45548 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatgacataaatatataaat

SEQ ID NO: 45549 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgacataaatatataaatt

SEQ ID NO: 45550 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gacataaatatataaattag

SEQ ID NO: 45551 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aattaggagttactttctat

SEQ ID NO: 45552 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
attaggagttactttctatt

SEQ ID NO: 45553 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggtaattcaatttgcctctt

SEQ ID NO: 45554 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atttgcctctttggctcatc

SEQ ID NO: 45555 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttgcctctttggctcatcc

SEQ ID NO: 45556 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acacaaccatcactatttca

SEQ ID NO: 45557 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cacaaccatcactatttcaa

SEQ ID NO: 45558 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcactatttcaaaggcatct

SEQ ID NO: 45559 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctcagatacgaaaaaaataa

SEQ ID NO: 45560 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaaaaaataaaagttgcaa

SEQ ID NO: 45561 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaaaataaaagttgcaaaa

SEQ ID NO: 45562 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaaataaaagttgcaaaag

SEQ ID NO: 45563 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaataaaagttgcaaaaga

SEQ ID NO: 45564 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttgcaaaagagggaattca

SEQ ID NO: 45565 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagagggaattcacagttc

SEQ ID NO: 45566 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaattcacagttcaagactc

SEQ ID NO: 45567 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aattcacagttcaagactct

SEQ ID NO: 45568 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttcaagactctgggaactc

SEQ ID NO: 45569 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caagactctgggaactcaag

SEQ ID NO: 45570 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aagactctgggaactcaagt

SEQ ID NO: 45571 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gactctgggaactcaagtgg

SEQ ID NO: 45572 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gggaactcaagtgggagatg

SEQ ID NO: 45573 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagtgggagatgaagattat

SEQ ID NO: 45574 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagatgaagattatgagaat

SEQ ID NO: 45575 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gatgaagattatgagaatta

SEQ ID NO: 45576 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaagattatgagaattagag

SEQ ID NO: 45577 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagattatgagaattagagc

SEQ ID NO: 45578 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatgagaattagagcaggaa

SEQ ID NO: 45579 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agaattagagcaggaaaagt

SEQ ID NO: 45580 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tagagcaggaaaagttagca

SEQ ID NO: 45581 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agagcaggaaaagttagcat

SEQ ID NO: 45582 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agcaggaaaagttagcatag

SEQ ID NO: 45583 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcaggaaaagttagcatagg

SEQ ID NO: 45584 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagttagcataggaggatta

SEQ ID NO: 45585 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taggaggattaaagacattt

SEQ ID NO: 45586 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaataaaatgtacactattt

SEQ ID NO: 45587 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cactattttagtgatctgaa

SEQ ID NO: 45588 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
actattttagtgatctgaat

SEQ ID NO: 45589 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acaaaacaaaacaaaaatga

SEQ ID NO: 45590 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaaatgacagaatttaaac

SEQ ID NO: 45591 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actggaaacattttaatctg

SEQ ID NO: 45592 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggaaacattttaatctgaa

SEQ ID NO: 45593 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggaaacattttaatctgaag

SEQ ID NO: 45594 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acattttaatctgaagaggc

SEQ ID NO: 45595 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttaatctgaagaggctgga

SEQ ID NO: 45596 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atctgaagaggctggaaaga

SEQ ID NO: 45597 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaggctggaaagaaagacct

SEQ ID NO: 45598 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaagaaagaccttagatgt

SEQ ID NO: 45599 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaagaaagaccttagatgta

SEQ ID NO: 45600 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccttagatgtaaggttttta

SEQ ID NO: 45601 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaggtttttatagttgacca

SEQ ID NO: 45602 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttatcaaacaaatttcctc

SEQ ID NO: 45603 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttctcaattcttatatttt

SEQ ID NO: 45604 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttctcaattcttatattttc

SEQ ID NO: 45605 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcaattcttatattttcagg

SEQ ID NO: 45606 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caattcttatattttcaggt

SEQ ID NO: 45607 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tacttaatatgacatacttt

SEQ ID NO: 45608 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acatactttgagatacgtca

SEQ ID NO: 45609 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtcatggaaaattttttatg

SEQ ID NO: 45610 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atggaaaattttttatgaag

SEQ ID NO: 45611 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggaaaattttttatgaaga

SEQ ID NO: 45612 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggaaaattttttatgaagaa

SEQ ID NO: 45613 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaagaagggtaaactttca

SEQ ID NO: 45614 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaactttcaaagttcataat

SEQ ID NO: 45615 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctttcaaagttcataattag

SEQ ID NO: 45616 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caaagttcataattagaagt

SEQ ID NO: 45617 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agttcataattagaagtcag

SEQ ID NO: 45618 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattagaagtcagtagcact

SEQ ID NO: 45619 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtcagtagcactaagaacct

SEQ ID NO: 45620 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cactaagaacctgagttctt

SEQ ID NO: 45621 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttaagtaataataatgatg

SEQ ID NO: 45622 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aacaaacactttttttaaaa

SEQ ID NO: 45623 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gctacatgacttaaaaatac

SEQ ID NO: 45624 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatctgttactacaacctct

SEQ ID NO: 45625 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atctgttactacaacctcta

SEQ ID NO: 45626 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgttactacaacctctaagg

SEQ ID NO: 45627 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atatttaattgtgcatacca

SEQ ID NO: 45628 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgcataccatggaaatgtaa

SEQ ID NO: 45629 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cataccatggaaatgtaata

SEQ ID NO: 45630 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccatggaaatgtaatagagt

SEQ ID NO: 45631 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgtacactcttttatcata

SEQ ID NO: 45632 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agatataaccattatgtaat

SEQ ID NO: 45633 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttatgtaatgagaaaaaaat

SEQ ID NO: 45634 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaaaaaattagtgaaaatc

SEQ ID NO: 45635 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttagtgaaaatcaagaatat

SEQ ID NO: 45636 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tattaacatcaaatgatttt

SEQ ID NO: 45637 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caaatgatttttagacaact

SEQ ID NO: 45638 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttttagacaactcagttta

SEQ ID NO: 45639 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttttagacaactcagtttat

SEQ ID NO: 45640 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttagacaactcagtttata

SEQ ID NO: 45641 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caactcagtttatagggcac

SEQ ID NO: 45642 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
cactagatttcatacgcttt

SEQ ID NO: 45643 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagatttcatacgctttcgg

SEQ ID NO: 45644 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agatttcatacgctttcgga

SEQ ID NO: 45645 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gatttcatacgctttcggaa

SEQ ID NO: 45646 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tacgctttcggaagggctca

SEQ ID NO: 45647 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcggaagggctcatggaat

SEQ ID NO: 45648 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agggctcatggaataagtga

SEQ ID NO: 45649 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggctcatggaataagtgaca

SEQ ID NO: 45650 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgacagagtaattttatgaa

SEQ ID NO: 45651 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atggttaaaataatctattt

SEQ ID NO: 45652 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaaatacaaataaaatcac

SEQ ID NO: 45653 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aataaaatcactagttataa

SEQ ID NO: 45654 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatcactagttataaaaga

SEQ ID NO: 45655 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acaccttcatctgcatgcca

SEQ ID NO: 45656 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccacagatatataaattcta

SEQ ID NO: 45657 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atataaattctatagctgca

SEQ ID NO: 45658 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agctgcatggctttataccc

SEQ ID NO: 45659 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gctgcatggctttatacccc

SEQ ID NO: 45660 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctgcatggctttatacccca

SEQ ID NO: 45661 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgcatggctttataccccag

SEQ ID NO: 45662 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
catggctttataccccaggg

SEQ ID NO: 45663 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cccaggggagacaaattatt

SEQ ID NO: 45664 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agacaaattattaagtccaa

SEQ ID NO: 45665 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gacaaattattaagtccaat

SEQ ID NO: 45666 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtttgttttgtgtttcaaa

SEQ ID NO: 45667 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttgtgtttcaaatggaca

SEQ ID NO: 45668 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgtgtttcaaatggacaaa

SEQ ID NO: 45669 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtgtttcaaatggacaaaga

SEQ ID NO: 45670 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtttcaaatggacaaagag

SEQ ID NO: 45671 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaatggacaaagagaggac

SEQ ID NO: 45672 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatggacaaagagaggacaa

SEQ ID NO: 45673 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggacaaagagaggacaaga

SEQ ID NO: 45674 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggacaaagagaggacaagag

SEQ ID NO: 45675 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caaagagaggacaagagagg

SEQ ID NO: 45676 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agagaggtagaaattccatt

SEQ ID NO: 45677 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagaaattccattgagctat

SEQ ID NO: 45678 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tccattgagctataagtcac

SEQ ID NO: 45679 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgagctataagtcacaagcc

SEQ ID NO: 45680 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagctataagtcacaagcct

SEQ ID NO: 45681 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caagcctaggactcttgaca

SEQ ID NO: 45682 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
actgtataactctataactc

SEQ ID NO: 45683 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gatttataactgtataactc

SEQ ID NO: 45684 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taaaatcacttccttttaat

SEQ ID NO: 45685 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttttaatgagtctgcttttt

SEQ ID NO: 45686 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatgagtctgctttttcagt

SEQ ID NO: 45687 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gctttttcagttagaaaatg

SEQ ID NO: 45688 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttagaaaatgaagtgctaaa

SEQ ID NO: 45689 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaatgaagtgctaaatgga

SEQ ID NO: 45690 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgctaaatggaaagttctat

SEQ ID NO: 45691 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gctaaatggaaagttctata

SEQ ID NO: 45692 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgttgcaactcaacatact

SEQ ID NO: 45693 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caactcaacatactaagaat

SEQ ID NO: 45694 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actaagaataagaattttgt

SEQ ID NO: 45695 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagaataagaattttgtcag

SEQ ID NO: 45696 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taagaattttgtcagcagct

SEQ ID NO: 45697 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagaattttgtcagcagcta

SEQ ID NO: 45698 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaattttgtcagcagctaag

SEQ ID NO: 45699 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcagctaaggagatccatga

SEQ ID NO: 45700 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagctaaggagatccatgaa

SEQ ID NO: 45701 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaggagatccatgaaaggt

SEQ ID NO: 45702 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagccattgactttaaatga

SEQ ID NO: 45703 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttaaatgaaagaaaaatgaa

SEQ ID NO: 45704 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taaatgaaagaaaaatgaac

SEQ ID NO: 45705 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaaagaaaaatgaacaggt

SEQ ID NO: 45706 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aataattcctcataaatgtt

SEQ ID NO: 45707 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaatgttaagaaataattt

SEQ ID NO: 45708 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgttaagaaataatttcag

SEQ ID NO: 45709 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaaataatttcagaagtctt

SEQ ID NO: 45710 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtctttggttgactttccc

SEQ ID NO: 45711 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgactttccccagctcctg

SEQ ID NO: 45712 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcctgaagtgctttaacacc

SEQ ID NO: 45713 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgctttaacacctagaatcc

SEQ ID NO: 45714 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tagaatccaagttttattct

SEQ ID NO: 45715 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaatccaagttttattctga

SEQ ID NO: 45716 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttctgagagcaactgtctgc

SEQ ID NO: 45717 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctgagagcaactgtctgcc

SEQ ID NO: 45718 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcaactgtctgccaggcaat

SEQ ID NO: 45719 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aactgtctgccaggcaattg

SEQ ID NO: 45720 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taattttaatcttctttaaa

SEQ ID NO: 45721 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aattttaatcttctttaaat

SEQ ID NO: 45722 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatcttctttaaatgggtga

SEQ ID NO: 45723 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcttctttaaatgggtgaca

SEQ ID NO: 45724 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctttaaatgggtgacagagt

SEQ ID NO: 45725 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatgggtgacagagttagt

SEQ ID NO: 45726 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagagttagttagaaaaaaa

SEQ ID NO: 45727 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agagttagttagaaaaaaat

SEQ ID NO: 45728 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttagaaaaaaataggtgact

SEQ ID NO: 45729 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaaaaataggtgactgagt

SEQ ID NO: 45730 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttccatatgatactaaacc

SEQ ID NO: 45731 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cctagatgcctgctccttaa

SEQ ID NO: 45732 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctagatgcctgctccttaaa

SEQ ID NO: 45733 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgctccttaaaaggcatacg

SEQ ID NO: 45734 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaatctgattttctaacttt

SEQ ID NO: 45735 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
actttaagctgaaatgaaca

SEQ ID NO: 45736 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgaacacggttttaaaattt

SEQ ID NO: 45737 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaacacggttttaaaatttt

SEQ ID NO: 45738 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acacggttttaaaattttgg

SEQ ID NO: 45739 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggagtattacttcttccatg

SEQ ID NO: 45740 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaaatatacaaataaaata

SEQ ID NO: 45741 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atatacaaataaaatacagc

SEQ ID NO: 45742 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cagctggccttctgtatccc

SEQ ID NO: 45743 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agctggccttctgtatccct

SEQ ID NO: 45744 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atccctgggtcccacatctg

SEQ ID NO: 45745 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccctgggtcccacatctgta

SEQ ID NO: 45746 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctgtagagtcaaccaacta

SEQ ID NO: 45747 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagagtcaaccaactacaga

SEQ ID NO: 45748 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aactacagatggaaaataat

SEQ ID NO: 45749 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaaaatacaacaataaaaa

SEQ ID NO: 45750 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatagtacaaataaaaaata

SEQ ID NO: 45751 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacaaatatttacattgtgt

SEQ ID NO: 45752 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgatttacttttacattat

SEQ ID NO: 45753 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttacattataagtaatctg

SEQ ID NO: 45754 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agtaatctgaagataattta

SEQ ID NO: 45755 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ataatttaaagtgtacatat

SEQ ID NO: 45756 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatttaaagtgtacatatga

SEQ ID NO: 45757 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atttaaagtgtacatatgag

SEQ ID NO: 45758 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacatatgagaggatgtgtg

SEQ ID NO: 45759 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acatatgagaggatgtgtgt

SEQ ID NO: 45760 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaggatgtgtgtaggtttta

SEQ ID NO: 45761 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acattgtgccattttatata

SEQ ID NO: 45762 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cattgtgccattttatataa

SEQ ID NO: 45763 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccattttatataaaggaatt

SEQ ID NO: 45764 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ataaaggaattgagcatctg

SEQ ID NO: 45765 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aattgagcatctgcagattt

SEQ ID NO: 45766 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctgcagattttagtctctg

SEQ ID NO: 45767 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctgcagattttagtctctgt

SEQ ID NO: 45768 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgcagattttagtctctgtg

SEQ ID NO: 45769 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcagattttagtctctgtgg

SEQ ID NO: 45770 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cagattttagtctctgtggg

SEQ ID NO: 45771 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gccttcaaactactcgccca

SEQ ID NO: 45772 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
actactcgcccatagatatc

SEQ ID NO: 45773 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctactcgcccatagatatcg

SEQ ID NO: 45774 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tactcgcccatagatatcga

SEQ ID NO: 45775 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catagatatcgagggatgac

SEQ ID NO: 45776 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gattccttactttaccgtct

SEQ ID NO: 45777 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgtcttggaaaaaatgtcct

SEQ ID NO: 45778 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaaaatgtccttggctaca

SEQ ID NO: 45779 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttattcactcaattaaata

SEQ ID NO: 45780 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tattcactcaattaaatata

SEQ ID NO: 45781 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cttatgtattgatttttttt

SEQ ID NO: 45782 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtattgattttttttgaga

SEQ ID NO: 45783 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tattgattttttttgagaca

SEQ ID NO: 45784 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgagacagagtctcactctg

SEQ ID NO: 45785 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agagtctcactctgtagtcc

SEQ ID NO: 45786 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctcactctgtagtccaagc

SEQ ID NO: 45787 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcactctgtagtccaagctg

SEQ ID NO: 45788 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgtagtccaagctggagtg

SEQ ID NO: 45789 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tagtccaagctggagtgcag

SEQ ID NO: 45790 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggagtgcagcggtgcgatct

SEQ ID NO: 45791 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cttactgcaacctccgcctc

SEQ ID NO: 45792 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tactgcaacctccgcctctg

SEQ ID NO: 45793 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacctccgcctctggagctc

SEQ ID NO: 45794 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcaagtgattctcatgcct

SEQ ID NO: 45795 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttctcatgcctcagcctcct

SEQ ID NO: 45796 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atatatatatatatatatat

SEQ ID NO: 45797 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tccatataatctcgttttcc

SEQ ID NO: 45798 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccaagtccactataaattca

SEQ ID NO: 45799 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagtccactataaattcatg

SEQ ID NO: 45800 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtccactataaattcatgg

SEQ ID NO: 45801 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtccactataaattcatgga

SEQ ID NO: 45802 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cactataaattcatggaggg

SEQ ID NO: 45803 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctataaattcatggagggtg

SEQ ID NO: 45804 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attcatggagggtggagtct

SEQ ID NO: 45805 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atggagggtggagtcttagt

SEQ ID NO: 45806 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gggtggagtcttagtaagtt

SEQ ID NO: 45807 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggtggagtcttagtaagtta

SEQ ID NO: 45808 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggagtcttagtaagttaag

SEQ ID NO: 45809 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtcttagtaagttaaggaga

SEQ ID NO: 45810 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttagtaagttaaggagatag

SEQ ID NO: 45811 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttaaggagatagaagatatt

SEQ ID NO: 45812 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtcaaatactttctaacat

SEQ ID NO: 45813 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatactttctaacatgagc

SEQ ID NO: 45814 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atactttctaacatgagcta

SEQ ID NO: 45815 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acatgagctagagaaaacaa

SEQ ID NO: 45816 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatttttaaatgatgcctt

SEQ ID NO: 45817 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgatgccttaagacttga

SEQ ID NO: 45818 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acttgaaagcaatctcataa

SEQ ID NO: 45819 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
cataaaagtaatttgtaata

SEQ ID NO: 45820 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caatacataccttgactcac

SEQ ID NO: 45821 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttgactcactagaaatatg

SEQ ID NO: 45822 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgactcactagaaatatgc

SEQ ID NO: 45823 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctcactagaaatatgcaggt

SEQ ID NO: 45824 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcactagaaatatgcaggta

SEQ ID NO: 45825 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cactagaaatatgcaggtaa

SEQ ID NO: 45826 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagaaatatgcaggtaaggg

SEQ ID NO: 45827 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agaaatatgcaggtaagggt

SEQ ID NO: 45828 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaatatgcaggtaagggtgg

SEQ ID NO: 45829 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atatgcaggtaagggtggga

SEQ ID NO: 45830 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatgcaggtaagggtgggag

SEQ ID NO: 45831 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgcaggtaagggtgggagag

SEQ ID NO: 45832 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcaggtaagggtgggagagg

SEQ ID NO: 45833 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caggtaagggtgggagagga

SEQ ID NO: 45834 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gggagaggagggcacaaaaa

SEQ ID NO: 45835 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggagaggagggcacaaaaaa

SEQ ID NO: 45836 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gggcacaaaaaaaggtttta

SEQ ID NO: 45837 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcacaaaaaaaggttttaaa

SEQ ID NO: 45838 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcctgttctcaatgaattta

SEQ ID NO: 45839 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttctcaaaaaattaaaattt

SEQ ID NO: 45840 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaatttaagattactgaatc

SEQ ID NO: 45841 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatttaagattactgaatcc

SEQ ID NO: 45842 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaagattactgaatccagg

SEQ ID NO: 45843 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agattactgaatccaggaag

SEQ ID NO: 45844 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aagaagtataaaattgtttg

SEQ ID NO: 45845 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attgtttgcggttcaaaaat

SEQ ID NO: 45846 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtttgcggttcaaaaatgag

SEQ ID NO: 45847 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttgcggttcaaaaatgaga

SEQ ID NO: 45848 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttgcggttcaaaaatgagaa

SEQ ID NO: 45849 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gagaagggactacatccatt

SEQ ID NO: 45850 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agaagggactacatccattt

SEQ ID NO: 45851 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaagggactacatccatttg

SEQ ID NO: 45852 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agggactacatccatttggg

SEQ ID NO: 45853 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acatccatttggggagaaat

SEQ ID NO: 45854 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catccatttggggagaaatt

SEQ ID NO: 45855 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tccatttggggagaaattag

SEQ ID NO: 45856 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccatttggggagaaattagg

SEQ ID NO: 45857 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
catttggggagaaattagga

SEQ ID NO: 45858 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gatgaaataaataacatttt

SEQ ID NO: 45859 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aataacattttgagaacatt

SEQ ID NO: 45860 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cattttgagaacattgagta

SEQ ID NO: 45861 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccctgacccaactgcgattt

SEQ ID NO: 45862 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttaagtattaacaatttaa

SEQ ID NO: 45863 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atttaatagatgataaatac

SEQ ID NO: 45864 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttaatagatgataaataca

SEQ ID NO: 45865 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttaatagatgataaatacaa

SEQ ID NO: 45866 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatacaagggtgatgccttg

SEQ ID NO: 45867 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atacaagggtgatgccttga

SEQ ID NO: 45868 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgccttgaaggattttgac

SEQ ID NO: 45869 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gccttgaaggattttgactg

SEQ ID NO: 45870 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgaaggattttgactggag

SEQ ID NO: 45871 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgaaggattttgactggaga

SEQ ID NO: 45872 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgactggagaaggaaatccc

SEQ ID NO: 45873 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggagaaggaaatcccaagca

SEQ ID NO: 45874 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aggaaatcccaagcaaagtg

SEQ ID NO: 45875 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaaatcccaagcaaagtgtg

SEQ ID NO: 45876 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatcccaagcaaagtgtgga

SEQ ID NO: 45877 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggagagtgtttatgacctaa

SEQ ID NO: 45878 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagagtgtttatgacctaaa

SEQ ID NO: 45879 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttatgacctaaaaggaaat

SEQ ID NO: 45880 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gacctaaaaggaaattggtt

SEQ ID NO: 45881 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaaggaaattggtttggta

SEQ ID NO: 45882 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaggaaattggtttggtac

SEQ ID NO: 45883 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttggtacaggtaaaaatcta

SEQ ID NO: 45884 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tggtacaggtaaaaatctat

SEQ ID NO: 45885 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acaggtaaaaatctatgggt

SEQ ID NO: 45886 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaaatctatgggtgagcac

SEQ ID NO: 45887 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaatctatgggtgagcact

SEQ ID NO: 45888 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatctatgggtgagcactag

SEQ ID NO: 45889 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatgggtgagcactaggaga

SEQ ID NO: 45890 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgggtgagcactaggagata

SEQ ID NO: 45891 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgagcactaggagatagagc

SEQ ID NO: 45892 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctaggagatagagctggtca

SEQ ID NO: 45893 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gagatagagctggtcaaagc

SEQ ID NO: 45894 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tagagctggtcaaagctggt

SEQ ID NO: 45895 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agagctggtcaaagctggtt

SEQ ID NO: 45896 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gagctggtcaaagctggtta

SEQ ID NO: 45897 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtcaaagctggttagggcca

SEQ ID NO: 45898 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctggttagggccatagtgtg

SEQ ID NO: 45899 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggttagggccatagtgtga

SEQ ID NO: 45900 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tagtgtgaaggctttgtgca

SEQ ID NO: 45901 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgtgcacagtacataattc

SEQ ID NO: 45902 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cagtacataattcgagactt

SEQ ID NO: 45903 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agtacataattcgagacttt

SEQ ID NO: 45904 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtacataattcgagactttg

SEQ ID NO: 45905 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ataattcgagactttgggga

SEQ ID NO: 45906 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcgagactttggggatggc

SEQ ID NO: 45907 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcgagactttggggatggcc

SEQ ID NO: 45908 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
actttggggatggccaggcg

SEQ ID NO: 45909 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttggggatggccaggcgtgg

SEQ ID NO: 45910 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtggctcactcctgtaatct

SEQ ID NO: 45911 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
actcctgtaatctcagcaac

SEQ ID NO: 45912 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctcctgtaatctcagcaact

SEQ ID NO: 45913 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcctgtaatctcagcaactg

SEQ ID NO: 45914 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatctcagcaactggggaaa

SEQ ID NO: 45915 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcaactggggaaaaagtttg

SEQ ID NO: 45916 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaagtttgaagaattgcct

SEQ ID NO: 45917 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttgaagaattgcctgagtc

SEQ ID NO: 45918 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaagaattgcctgagtccag

SEQ ID NO: 45919 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgcctgagtccagtagttt

SEQ ID NO: 45920 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgagtccagtagtttgagac

SEQ ID NO: 45921 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccagtagtttgagaccagcc

SEQ ID NO: 45922 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cagtagtttgagaccagcct

SEQ ID NO: 45923 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgagaccagcctgggaaaca

SEQ ID NO: 45924 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acaaacttttttaaaaaaat

SEQ ID NO: 45925 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acttttttaaaaaaattagc

SEQ ID NO: 45926 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cttttttaaaaaaattagct

SEQ ID NO: 45927 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaaaattagctgggtgttg

SEQ ID NO: 45928 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attagctgggtgttgtggca

SEQ ID NO: 45929 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttagctgggtgttgtggcat

SEQ ID NO: 45930 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggtgttgtggcatgggtgtg

SEQ ID NO: 45931 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtggcatgggtgtgtagtcc

SEQ ID NO: 45932 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggtgtgtagtcccagcaact

SEQ ID NO: 45933 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtgtgtagtcccagcaactc

SEQ ID NO: 45934 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtgtagtcccagcaactcag

SEQ ID NO: 45935 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtagtcccagcaactcagg

SEQ ID NO: 45936 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtcccagcaactcaggagg

SEQ ID NO: 45937 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcccagcaactcaggaggtg

SEQ ID NO: 45938 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccagcaactcaggaggtgg

SEQ ID NO: 45939 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agcaactcaggaggtggagg

SEQ ID NO: 45940 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcaactcaggaggtggaggc

SEQ ID NO: 45941 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aactcaggaggtggaggcag

SEQ ID NO: 45942 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actcaggaggtggaggcagg

SEQ ID NO: 45943 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggaggcaggaggatcactt

SEQ ID NO: 45944 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcaggaggatcacttgagcc

SEQ ID NO: 45945 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caggaggatcacttgagccc

SEQ ID NO: 45946 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggaggatcacttgagcccag

SEQ ID NO: 45947 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcacttgagcccaggagttc

SEQ ID NO: 45948 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cacttgagcccaggagttca

SEQ ID NO: 45949 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agcccaggagttcaaggttg

SEQ ID NO: 45950 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caggagttcaaggttgcagt

SEQ ID NO: 45951 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaggttgcagtaagctatga

SEQ ID NO: 45952 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgatagcaccactgtactc

SEQ ID NO: 45953 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agcaccactgtactccagac

SEQ ID NO: 45954 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcaccactgtactccagact

SEQ ID NO: 45955 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgtactccagactgggcaa

SEQ ID NO: 45956 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtactccagactgggcaaca

SEQ ID NO: 45957 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tccagactgggcaacagagt

SEQ ID NO: 45958 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtctccgttttttaaaaaa

SEQ ID NO: 45959 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctccgttttttaaaaaaaag

SEQ ID NO: 45960 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccgttttttaaaaaaaagaa

SEQ ID NO: 45961 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gttttttaaaaaaaagaaga

SEQ ID NO: 45962 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttttaaaaaaaagaagaga

SEQ ID NO: 45963 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttaaaaaaaagaagagaga

SEQ ID NO: 45964 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taaaaaaaagaagagagaga

SEQ ID NO: 45965 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaaaaagaagagagagaga

SEQ ID NO: 45966 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaaagaagagagagagaga

SEQ ID NO: 45967 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaagaagagagagagagaga

SEQ ID NO: 45968 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
agagagagagcgatactttg

SEQ ID NO: 45969 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gagcgatactttgcggatca

SEQ ID NO: 45970 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcggatcatggatacatcat

SEQ ID NO: 45971 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggatcatggatacatcatga

SEQ ID NO: 45972 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catcatgagagtgaaatgat

SEQ ID NO: 45973 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atcatgagagtgaaatgatt

SEQ ID NO: 45974 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gattaggactgaatctgcat

SEQ ID NO: 45975 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgagcgaaaataatcaaat

SEQ ID NO: 45976 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaataatcaaataagtaaac

SEQ ID NO: 45977 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ataatcaaataagtaaacta

SEQ ID NO: 45978 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaactagagtaaatgcaaaa

SEQ ID NO: 45979 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctagagtaaatgcaaaatgg

SEQ ID NO: 45980 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagtaaatgcaaaatggaag

SEQ ID NO: 45981 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtaaatgcaaaatggaagca

SEQ ID NO: 45982 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taaatgcaaaatggaagcag

SEQ ID NO: 45983 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caaaatggaagcagaggcat

SEQ ID NO: 45984 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggaagcagaggcatcagtt

SEQ ID NO: 45985 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agttgagactctgcttgaaa

SEQ ID NO: 45986 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agactctgcttgaaatggtt

SEQ ID NO: 45987 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gactctgcttgaaatggttt

SEQ ID NO: 45988 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttgaaatggtttaggcaaa

SEQ ID NO: 45989 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaaatggtttaggcaaaaag

SEQ ID NO: 45990 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggtttaggcaaaaagtagt

SEQ ID NO: 45991 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggcaaaaagtagtgagtaca

SEQ ID NO: 45992 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcaaaaagtagtgagtacaa

SEQ ID NO: 45993 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagtagtgagtacaaagga

SEQ ID NO: 45994 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagtagtgagtacaaaggaa

SEQ ID NO: 45995 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacaaaggaaaggtgatgaa

SEQ ID NO: 45996 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acaaaggaaaggtgatgaaa

SEQ ID NO: 45997 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaggaaaggtgatgaaaag

SEQ ID NO: 45998 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aggaaaggtgatgaaaagga

SEQ ID NO: 45999 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggaaaggtgatgaaaaggag

SEQ ID NO: 46000 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaggtgatgaaaaggagagg

SEQ ID NO: 46001 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaggagaggtggattcaaa

SEQ ID NO: 46002 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaggagaggtggattcaaac

SEQ ID NO: 46003 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtggattcaaacaggcactg

SEQ ID NO: 46004 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggattcaaacaggcactgtg

SEQ ID NO: 46005 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gattcaaacaggcactgtgg

SEQ ID NO: 46006 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
attcaaacaggcactgtgga

SEQ ID NO: 46007 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcaaacaggcactgtggagg

SEQ ID NO: 46008 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgtgtaacttttcaactga

SEQ ID NO: 46009 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtgtaacttttcaactgac

SEQ ID NO: 46010 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttttcaactgacaggaaaca

SEQ ID NO: 46011 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttcaactgacaggaaacat

SEQ ID NO: 46012 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgacaggaaacatgggatg

SEQ ID NO: 46013 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aggaaacatgggatgaagca

SEQ ID NO: 46014 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggaaacatgggatgaagcat

SEQ ID NO: 46015 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacatgggatgaagcatggg

SEQ ID NO: 46016 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acatgggatgaagcatggga

SEQ ID NO: 46017 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgaagcatgggaaggctca

SEQ ID NO: 46018 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaaggctcaaagataccttt

SEQ ID NO: 46019 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tacctttgagctttctcata

SEQ ID NO: 46020 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgagctttctcatacagct

SEQ ID NO: 46021 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gctttctcatacagctaagt

SEQ ID NO: 46022 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtaagattaaatcaattatt

SEQ ID NO: 46023 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttaaatcaattattaagaac

SEQ ID NO: 46024 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atcaattattaagaactagt

SEQ ID NO: 46025 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aactagtaagaaaactttac

SEQ ID NO: 46026 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aactttaccagatgaatctt

SEQ ID NO: 46027 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actttaccagatgaatcttc

SEQ ID NO: 46028 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaccagatgaatcttcagg

SEQ ID NO: 46029 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttcaggaagctgttgtgta

SEQ ID NO: 46030 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccatcactacatgcaatgtt

SEQ ID NO: 46031 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcactacatgcaatgttaag

SEQ ID NO: 46032 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttaagaagaacttatgacaa

SEQ ID NO: 46033 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattgttaatatgaaacaca

SEQ ID NO: 46034 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatgaaacacaaagtatatg

SEQ ID NO: 46035 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcactatccgaatcactgct

SEQ ID NO: 46036 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cgaatcactgctaagttcct

SEQ ID NO: 46037 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
agcattcatattttccaaat

SEQ ID NO: 46038 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attttccaaatcggattccc

SEQ ID NO: 46039 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttttccaaatcggattcccc

SEQ ID NO: 46040 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcggattccccaggtgcaat

SEQ ID NO: 46041 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcaattggcactgtcactgt

SEQ ID NO: 46042 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caattggcactgtcactgtg

SEQ ID NO: 46043 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggcactgtcactgtgaggc

SEQ ID NO: 46044 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggcactgtcactgtgaggct

SEQ ID NO: 46045 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaccatcactgtcttccatc

SEQ ID NO: 46046 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgattttatctttttcctt

SEQ ID NO: 46047 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgattttatctttttccttg

SEQ ID NO: 46048 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attgtgacctttgctcattt

SEQ ID NO: 46049 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgacctttgctcatttcagc

SEQ ID NO: 46050 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgctcatttcagcaagtgta

SEQ ID NO: 46051 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catttcagcaagtgtatggt

SEQ ID NO: 46052 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caagtgtatggttagaaata

SEQ ID NO: 46053 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agaaatatagttttccttct

SEQ ID NO: 46054 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tagttttccttcttagtatt

SEQ ID NO: 46055 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttctgcttgtcttatctccc

SEQ ID NO: 46056 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cttatctccctggaaatctt

SEQ ID NO: 46057 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cctggaaatctttggctttt

SEQ ID NO: 46058 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggctttttggaaaatgcttt

SEQ ID NO: 46059 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttttagaataaattcacgt

SEQ ID NO: 46060 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttttagaataaattcacgta

SEQ ID NO: 46061 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atttattccctttttaattc

SEQ ID NO: 46062 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taattctagtcactgcaatc

SEQ ID NO: 46063 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attctagtcactgcaatctg

SEQ ID NO: 46064 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttctagtcactgcaatctgg

SEQ ID NO: 46065 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatctggaggttgtttgcat

SEQ ID NO: 46066 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atctggaggttgtttgcatc

SEQ ID NO: 46067 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tctggaggttgtttgcatca

SEQ ID NO: 46068 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gggtcttcttcaattgctgt

SEQ ID NO: 46069 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taagattgtctgaactaaat

SEQ ID NO: 46070 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aactaaatgagctcaataat

SEQ ID NO: 46071 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actaaatgagctcaataata

SEQ ID NO: 46072 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatgagctcaataataaggc

SEQ ID NO: 46073 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctcaataataaggccagaaa

SEQ ID NO: 46074 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcaataataaggccagaaat

SEQ ID NO: 46075 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aataaggccagaaataggtt

SEQ ID NO: 46076 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ataaggccagaaataggttt

SEQ ID NO: 46077 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aataggtttaggacctatat

SEQ ID NO: 46078 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ataggtttaggacctatatc

SEQ ID NO: 46079 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taggtttaggacctatatca

SEQ ID NO: 46080 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtttaggacctatatcaggg

SEQ ID NO: 46081 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttaggacctatatcagggt

SEQ ID NO: 46082 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttaggacctatatcagggtg

SEQ ID NO: 46083 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aggacctatatcagggtggg

SEQ ID NO: 46084 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gacctatatcagggtgggga

SEQ ID NO: 46085 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acctatatcagggtggggag

SEQ ID NO: 46086 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctatatcagggtggggaga

SEQ ID NO: 46087 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctatatcagggtggggagag

SEQ ID NO: 46088 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tatatcagggtggggagagg

SEQ ID NO: 46089 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atcagggtggggagaggggg

SEQ ID NO: 46090 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagggtggggagagggggta

SEQ ID NO: 46091 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggggagagggggtagagaaa

SEQ ID NO: 46092 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gggagagggggtagagaaat

SEQ ID NO: 46093 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggagagggggtagagaaata

SEQ ID NO: 46094 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agagggggtagagaaatagg

SEQ ID NO: 46095 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggggtagagaaatagggaga

SEQ ID NO: 46096 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gggtagagaaatagggagac

SEQ ID NO: 46097 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tataaaaaataaaataaaat

SEQ ID NO: 46098 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taagtacacttttccgaata

SEQ ID NO: 46099 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagtacacttttccgaatat

SEQ ID NO: 46100 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atataggccacaatacaaac

SEQ ID NO: 46101 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cacaatacaaaccagcaacg

SEQ ID NO: 46102 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tttctgcaccttttcacaca

SEQ ID NO: 46103 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcaccttttcacacacggat

SEQ ID NO: 46104 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acacacggataagaccacat

SEQ ID NO: 46105 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acacggataagaccacatga

SEQ ID NO: 46106 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acggataagaccacatgaga

SEQ ID NO: 46107 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ataagaccacatgagagaga

SEQ ID NO: 46108 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagaccacatgagagagaca

SEQ ID NO: 46109 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agaccacatgagagagacag

SEQ ID NO: 46110 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cacatgagagagacagaggc

SEQ ID NO: 46111 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acatgagagagacagaggcg

SEQ ID NO: 46112 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
catgagagagacagaggcga

SEQ ID NO: 46113 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagagagacagaggcgaggg

SEQ ID NO: 46114 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
actcctcatcactgtatccc

SEQ ID NO: 46115 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcatcactgtatccctagac

SEQ ID NO: 46116 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatccctagactagcccctg

SEQ ID NO: 46117 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tagactagcccctgcagact

SEQ ID NO: 46118 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actagcccctgcagactcag

SEQ ID NO: 46119 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agcccctgcagactcagcag

SEQ ID NO: 46120 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cccctgcagactcagcagca

SEQ ID NO: 46121 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccctgcagactcagcagcag

SEQ ID NO: 46122 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctgcagactcagcagcaga

SEQ ID NO: 46123 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagactcagcagcagagggt

SEQ ID NO: 46124 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agcagagggtcagccatacc

SEQ ID NO: 46125 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcagagggtcagccataccc

SEQ ID NO: 46126 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagggtcagccatacccagg

SEQ ID NO: 46127 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atacccaggaagaattacca

SEQ ID NO: 46128 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tacccaggaagaattaccat

SEQ ID NO: 46129 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acccaggaagaattaccatg

SEQ ID NO: 46130 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccaggaagaattaccatggg

SEQ ID NO: 46131 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggaagaattaccatggggag

SEQ ID NO: 46132 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagaattaccatggggagca

SEQ ID NO: 46133 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaattaccatggggagcaga

SEQ ID NO: 46134 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attatcattacatcatttct

SEQ ID NO: 46135 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catttctaagttcatttctg

SEQ ID NO: 46136 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttctaagttcatttctgtag

SEQ ID NO: 46137 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taagttcatttctgtagcag

SEQ ID NO: 46138 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtagcagtagtgccttaatc

SEQ ID NO: 46139 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgaacccaaaaaactctcc

SEQ ID NO: 46140 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cattactctttattacctgt

SEQ ID NO: 46141 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctttattacctgtgagaaa

SEQ ID NO: 46142 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctttattacctgtgagaaac

SEQ ID NO: 46143 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tattacctgtgagaaacagg

SEQ ID NO: 46144 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gactattttctattgtgcta

SEQ ID NO: 46145 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagatctttgttcactttac

SEQ ID NO: 46146 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atctttgttcactttaccag

SEQ ID NO: 46147 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgtcacttgttctaacaaa

SEQ ID NO: 46148 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggaacacataatacttaca

SEQ ID NO: 46149 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtaataaaatattctgtcc

SEQ ID NO: 46150 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aataaaatattctgtccaag

SEQ ID NO: 46151 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attctgtccaagaagcgtgc

SEQ ID NO: 46152 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actgcttaatgtgactttta

SEQ ID NO: 46153 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttaatgtgacttttaaagca

SEQ ID NO: 46154 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgacttttaaagcacagaa

SEQ ID NO: 46155 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgacttttaaagcacagaaa

SEQ ID NO: 46156 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acctgattcacatgcaataa

SEQ ID NO: 46157 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgcaataatggcattatgat

SEQ ID NO: 46158 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ataatggcattatgattggc

SEQ ID NO: 46159 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attgcctattatgtttgccc

SEQ ID NO: 46160 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcctattatgtttgccctag

SEQ ID NO: 46161 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctattatgtttgccctagaa

SEQ ID NO: 46162 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccctagaagagattacaaaa

SEQ ID NO: 46163 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cctagaagagattacaaaaa

SEQ ID NO: 46164 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaagagattacaaaaaaggt

SEQ ID NO: 46165 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagagattacaaaaaaggtc

SEQ ID NO: 46166 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggacaatttctattctcttg

SEQ ID NO: 46167 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atttctattctcttgaagca

SEQ ID NO: 46168 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgaagcaaagttttatttct

SEQ ID NO: 46169 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attatttttttttctcactg

SEQ ID NO: 46170 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atttttttttctcactgaag

SEQ ID NO: 46171 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttttttctcactgaagtag

SEQ ID NO: 46172 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttctcactgaagtagaagtg

SEQ ID NO: 46173 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctcactgaagtagaagtgc

SEQ ID NO: 46174 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtaaaaaaaaaaaatgttca

SEQ ID NO: 46175 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaaaaaaaaaatgttcaca

SEQ ID NO: 46176 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaaaaaaaaatgttcacag

SEQ ID NO: 46177 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaaaaaaaatgttcacaga

SEQ ID NO: 46178 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaaaaatgttcacagaggg

SEQ ID NO: 46179 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaaaatgttcacagagggc

SEQ ID NO: 46180 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatttaaacattgttttatc

SEQ ID NO: 46181 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atttaaacattgttttatcc

SEQ ID NO: 46182 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttttatccaggaaacaaaa

SEQ ID NO: 46183 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttttatccaggaaacaaaaa

SEQ ID NO: 46184 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aacaaaaaaggaaattgaat

SEQ ID NO: 46185 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attgaattggcatttgatgt

SEQ ID NO: 46186 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atttgatgtaagtcttttca

SEQ ID NO: 46187 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acctcatgttttaaaaatcg

SEQ ID NO: 46188 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catgttttaaaaatcgaagt

SEQ ID NO: 46189 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atcgaagtaagacctaactg

SEQ ID NO: 46190 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cgaagtaagacctaactgaa

SEQ ID NO: 46191 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agtaagacctaactgaagag

SEQ ID NO: 46192 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtaagacctaactgaagaga

SEQ ID NO: 46193 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaggtactcatccctcattt

SEQ ID NO: 46194 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atacctaaaacaatttctct

SEQ ID NO: 46195 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaacaatttctctgagatgt

SEQ ID NO: 46196 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atttctctgagatgtaagta

SEQ ID NO: 46197 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctctgagatgtaagtaaaga

SEQ ID NO: 46198 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgagatgtaagtaaagacag

SEQ ID NO: 46199 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagatgtaagtaaagacagc

SEQ ID NO: 46200 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctaaaattgtgtgtctcaat

SEQ ID NO: 46201 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtgtctcaataagtctgatt

SEQ ID NO: 46202 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtctcaataagtctgattt

SEQ ID NO: 46203 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctcaataagtctgatttag

SEQ ID NO: 46204 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctgatttaggagaaaattc

SEQ ID NO: 46205 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgatttaggagaaaattctg

SEQ ID NO: 46206 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gatttaggagaaaattctgg

SEQ ID NO: 46207 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
taggagaaaattctggaggt

SEQ ID NO: 46208 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggagaaaattctggaggtcg

SEQ ID NO: 46209 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagaaaattctggaggtcgg

SEQ ID NO: 46210 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aattctggaggtcggaggtc

SEQ ID NO: 46211 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
attctggaggtcggaggtct

SEQ ID NO: 46212 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggtcggaggtctgggaatca

SEQ ID NO: 46213 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attgctaaaaatccctgaaa

SEQ ID NO: 46214 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatccctgaaatggtttaa

SEQ ID NO: 46215 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttaatagttgtcaatgaaa

SEQ ID NO: 46216 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttgtgtatatttgttttaa

SEQ ID NO: 46217 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgtgtatatttgttttaat

SEQ ID NO: 46218 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atttgttttaataggaatat

SEQ ID NO: 46219 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttaataggaatattggtg

SEQ ID NO: 46220 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aggaatattggtgaagatct

SEQ ID NO: 46221 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggaatattggtgaagatctg

SEQ ID NO: 46222 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaatattggtgaagatctga

SEQ ID NO: 46223 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagggtccattttactgctt

SEQ ID NO: 46224 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttagtctccttaatctgttc

SEQ ID NO: 46225 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caagcgttaaaccattttaa

SEQ ID NO: 46226 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagcgttaaaccattttaac

SEQ ID NO: 46227 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agcgttaaaccattttaaca

SEQ ID NO: 46228 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaaccattttaacagggtg

SEQ ID NO: 46229 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
accattttaacagggtgcag

SEQ ID NO: 46230 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
acagggtgcagtggctcatg

SEQ ID NO: 46231 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
catgcggttctcacttcgtt

SEQ ID NO: 46232 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggttctcacttcgttgagaa

SEQ ID NO: 46233 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttctttccttcaaaaatcat

SEQ ID NO: 46234 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctctaatatttctataacc

SEQ ID NO: 46235 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctaatatttctataacctag

SEQ ID NO: 46236 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taatatttctataacctagt

SEQ ID NO: 46237 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gggtatcacaaatcaaaata

SEQ ID NO: 46238 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttgtattatcatgttaaac

SEQ ID NO: 46239 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtattatcatgttaaacaa

SEQ ID NO: 46240 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attatcatgttaaacaagag

SEQ ID NO: 46241 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaatgtatacttgattca

SEQ ID NO: 46242 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caaagtctcattttgattaa

SEQ ID NO: 46243 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttgattaatggtcttcgc

SEQ ID NO: 46244 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcttcgcaagtttcctgata

SEQ ID NO: 46245 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagtttcctgatatagaccc

SEQ ID NO: 46246 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caaatgttttcctaaaccta

SEQ ID NO: 46247 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccttaaccatttcaattaac

SEQ ID NO: 46248 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actggcaataaaatgatcaa

SEQ ID NO: 46249 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatgatcaaaagaataaat

SEQ ID NO: 46250 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgatcaaaagaataaatta

SEQ ID NO: 46251 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaattagagaaatataaaaa

SEQ ID NO: 46252 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attagagaaatataaaaaaa

SEQ ID NO: 46253 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agagaaatataaaaaaagag

SEQ ID NO: 46254 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaatataaaaaaagagaagc

SEQ ID NO: 46255 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaaaaaagagaagccagtt

SEQ ID NO: 46256 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttagcatataactctaatg

SEQ ID NO: 46257 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcatataactctaatgtgg

SEQ ID NO: 46258 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcatataactctaatgtgga

SEQ ID NO: 46259 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctaatgtggaaggctatat

SEQ ID NO: 46260 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctaatgtggaaggctatatc

SEQ ID NO: 46261 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaattttaattctatgatat

SEQ ID NO: 46262 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttaattctatgatattgg

SEQ ID NO: 46263 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gatattggtagttcctccat

SEQ ID NO: 46264 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggtagttcctccattagtc

SEQ ID NO: 46265 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtagttcctccattagtcaa

SEQ ID NO: 46266 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcctccattagtcaagagt

SEQ ID NO: 46267 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttctgtatactttctttgcc

SEQ ID NO: 46268 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgccaagaattaataatta

SEQ ID NO: 46269 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taattaaagaataataatat

SEQ ID NO: 46270 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaagaataataatatgagt

SEQ ID NO: 46271 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaatctatattgcctttca

SEQ ID NO: 46272 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaatctatattgcctttcaa

SEQ ID NO: 46273 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggaaaacataactctcacac

SEQ ID NO: 46274 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attatattatccattgttca

SEQ ID NO: 46275 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttatattatccattgttcaa

SEQ ID NO: 46276 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccacttcaaaaacctccctt

SEQ ID NO: 46277 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acctcccttaagtctcaatc

SEQ ID NO: 46278 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caatctagaactctttcttt

SEQ ID NO: 46279 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaactctttctttaagtgt

SEQ ID NO: 46280 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actctttctttaagtgtcag

SEQ ID NO: 46281 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agcattttatttaaccttat

SEQ ID NO: 46282 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attttatttaaccttattgg

SEQ ID NO: 46283 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccacttttctgtgccctaat

SEQ ID NO: 46284 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctaataagcatcttaaaaac

SEQ ID NO: 46285 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taataagcatcttaaaaaca

SEQ ID NO: 46286 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agcatcttaaaaacaaggat

SEQ ID NO: 46287 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taaaaacaaggattagacca

SEQ ID NO: 46288 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaaacaaggattagaccat

SEQ ID NO: 46289 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aggattagaccatgggtaat

SEQ ID NO: 46290 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agaccatgggtaattggttt

SEQ ID NO: 46291 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cctaaatacctttcttttca

SEQ ID NO: 46292 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taaatacctttcttttcaca

SEQ ID NO: 46293 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atacctttcttttcacagag

SEQ ID NO: 46294 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaagatactaaaaaatatt

SEQ ID NO: 46295 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agatactaaaaaatattgag

SEQ ID NO: 46296 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaatattgagtggaaaatg

SEQ ID NO: 46297 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tattgagtggaaaatgtggt

SEQ ID NO: 46298 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgagtggaaaatgtggtga

SEQ ID NO: 46299 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggaaaatgtggtgagagcc

SEQ ID NO: 46300 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggaaaatgtggtgagagcca

SEQ ID NO: 46301 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaaaatgtggtgagagccaa

SEQ ID NO: 46302 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttaaattatttgtgattat

SEQ ID NO: 46303 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtgattattggctttgatg

SEQ ID NO: 46304 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgatgtggcatgttttcac

SEQ ID NO: 46305 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attttatgtcaaaattttgt

SEQ ID NO: 46306 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatgtcaaaattttgtaag

SEQ ID NO: 46307 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attttgtaagaagaaatgca

SEQ ID NO: 46308 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtaagaagaaatgcacagc

SEQ ID NO: 46309 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtaagaagaaatgcacagct

SEQ ID NO: 46310 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagaaatgcacagctgggcg

SEQ ID NO: 46311 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatgcacagctgggcgcag

SEQ ID NO: 46312 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtagctcacgcctgtaattc

SEQ ID NO: 46313 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgcctgtaattctagcactt

SEQ ID NO: 46314 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcctgtaattctagcacttt

SEQ ID NO: 46315 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgtaattctagcactttgg

SEQ ID NO: 46316 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtaattctagcactttggg

SEQ ID NO: 46317 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tctagcactttgggaggcga

SEQ ID NO: 46318 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tagcactttgggaggcgacg

SEQ ID NO: 46319 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agcactttgggaggcgacgg

SEQ ID NO: 46320 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctttgggaggcgacggaggc

SEQ ID NO: 46321 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cgacggaggctggatcacct

SEQ ID NO: 46322 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gacggaggctggatcacctg

SEQ ID NO: 46323 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaggctggatcacctgaggt

SEQ ID NO: 46324 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aggctggatcacctgaggtc

SEQ ID NO: 46325 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gctggatcacctgaggtcag

SEQ ID NO: 46326 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcacctgaggtcaggagttc

SEQ ID NO: 46327 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgaggtcaggagttcgagac

SEQ ID NO: 46328 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcaggagttcgagaccagcc

SEQ ID NO: 46329 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctactaaaaatacaaaaat

SEQ ID NO: 46330 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctaaaaatacaaaaattagc

SEQ ID NO: 46331 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aatacaaaaattagctggca

SEQ ID NO: 46332 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acaaaaattagctggcacgg

SEQ ID NO: 46333 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtagcatgcacctgtaatct

SEQ ID NO: 46334 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cacctgtaatctcagctact

SEQ ID NO: 46335 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acctgtaatctcagctactc

SEQ ID NO: 46336 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgtaatctcagctactcag

SEQ ID NO: 46337 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtaatctcagctactcagg

SEQ ID NO: 46338 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctcagctactcaggaggct

SEQ ID NO: 46339 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctcagctactcaggaggctg

SEQ ID NO: 46340 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agctactcaggaggctgagg

SEQ ID NO: 46341 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tactcaggaggctgaggcag

SEQ ID NO: 46342 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcagaagaattgcttgaacc

SEQ ID NO: 46343 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cagaagaattgcttgaacct

SEQ ID NO: 46344 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaagaattgcttgaacctgg

SEQ ID NO: 46345 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagaattgcttgaacctggg

SEQ ID NO: 46346 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aattgcttgaacctgggagg

SEQ ID NO: 46347 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgcttgaacctgggaggtg

SEQ ID NO: 46348 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgcttgaacctgggaggtgg

SEQ ID NO: 46349 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgaacctgggaggtggaggt

SEQ ID NO: 46350 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaacctgggaggtggaggtt

SEQ ID NO: 46351 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aacctgggaggtggaggttg

SEQ ID NO: 46352 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgggaggtggaggttggggt

SEQ ID NO: 46353 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggtggaggttggggtgagcc

SEQ ID NO: 46354 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagatcacatcattgcactc

SEQ ID NO: 46355 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cacatcattgcactccagcc

SEQ ID NO: 46356 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acatcattgcactccagcct

SEQ ID NO: 46357 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcactccagcctgggcaaca

SEQ ID NO: 46358 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tccagcctgggcaacaaagc

SEQ ID NO: 46359 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaaaaaaaaaaaaatacac

SEQ ID NO: 46360 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacacaagcaaatcctgcta

SEQ ID NO: 46361 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acacaagcaaatcctgctat

SEQ ID NO: 46362 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acaagcaaatcctgctatag

SEQ ID NO: 46363 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aggagcttataaatacaaaa

SEQ ID NO: 46364 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gagcttataaatacaaaaca

SEQ ID NO: 46365 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttataaatacaaaacagag

SEQ ID NO: 46366 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataaatacaaaacagagaag

SEQ ID NO: 46367 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaacagagaagaagaaaca

SEQ ID NO: 46368 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aacagagaagaagaaacaaa

SEQ ID NO: 46369 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgtgcatttcattccatat

SEQ ID NO: 46370 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcatttcattccatattgg

SEQ ID NO: 46371 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcatttcattccatattgga

SEQ ID NO: 46372 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccatattggaaggaatttgt

SEQ ID NO: 46373 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catattggaaggaatttgta

SEQ ID NO: 46374 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttgtaaggctatataaaac

SEQ ID NO: 46375 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgtaaggctatataaaact

SEQ ID NO: 46376 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaggctatataaaactagg

SEQ ID NO: 46377 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cttatttattactacaactt

SEQ ID NO: 46378 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttatttattactacaacttg

SEQ ID NO: 46379 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tatttattactacaacttga

SEQ ID NO: 46380 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgagggtgatcaacaatta

SEQ ID NO: 46381 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggtgatcaacaattatagaa

SEQ ID NO: 46382 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acaattatagaatggtaatc

SEQ ID NO: 46383 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caattatagaatggtaatcc

SEQ ID NO: 46384 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caggatgtatattttttgtg

SEQ ID NO: 46385 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttttgtgcagtaaaaatc

SEQ ID NO: 46386 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taaatgcctttgtgtatgtc

SEQ ID NO: 46387 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcctttgtgtatgtctggca

SEQ ID NO: 46388 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgtctggcacagtatcatt

SEQ ID NO: 46389 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtatcatttagtgtgtgac

SEQ ID NO: 46390 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgtgtgactggatgaatgt

SEQ ID NO: 46391 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acttctgaatcctcttttta

SEQ ID NO: 46392 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctgaatcctctttttatgg

SEQ ID NO: 46393 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cctctttttatggtggttac

SEQ ID NO: 46394 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctctttttatggtggttaca

SEQ ID NO: 46395 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttacaaggacaacaatattt

SEQ ID NO: 46396 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttagtaatttttttcaact

SEQ ID NO: 46397 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtaatttttttcaactcag

SEQ ID NO: 46398 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtaatttttttcaactcagt

SEQ ID NO: 46399 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atttttttcaactcagtggg

SEQ ID NO: 46400 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttcaactcagtgggaagtg

SEQ ID NO: 46401 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttcaactcagtgggaagtga

SEQ ID NO: 46402 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagtgaaggcacttaccata

SEQ ID NO: 46403 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgttaccatatcccaccttc

SEQ ID NO: 46404 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccaccttctggatacctgat

SEQ ID NO: 46405 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
accttctggatacctgatga

SEQ ID NO: 46406 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgatgagagatttgatgtc

SEQ ID NO: 46407 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcaagctgaccaactgtgac

SEQ ID NO: 46408 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccaactgtgacaagtcaacg

SEQ ID NO: 46409 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actgtgacaagtcaacgtgg

SEQ ID NO: 46410 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caagtcaacgtggcagattt

SEQ ID NO: 46411 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acgtggcagatttgagaatt

SEQ ID NO: 46412 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcagatttgagaattgagat

SEQ ID NO: 46413 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gatttgagaattgagatgag

SEQ ID NO: 46414 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaattgagatgagtggctca

SEQ ID NO: 46415 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgagatgagtggctcatag

SEQ ID NO: 46416 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gagatgagtggctcatagaa

SEQ ID NO: 46417 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cccaattttctcctgcttgt

SEQ ID NO: 46418 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctcctgcttgtaagcttga

SEQ ID NO: 46419 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcttgaaagttttcactaat

SEQ ID NO: 46420 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagttttcactaatcagtat

SEQ ID NO: 46421 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agttttcactaatcagtata

SEQ ID NO: 46422 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttcactaatcagtataagg

SEQ ID NO: 46423 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaagaaaaaaaataaaaaaa

SEQ ID NO: 46424 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaaataaaaaaaaagtac

SEQ ID NO: 46425 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataaaaaaaaagtacaagcc

SEQ ID NO: 46426 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caagaaaacactaattcaaa

SEQ ID NO: 46427 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaaaacactaattcaaaaag

SEQ ID NO: 46428 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaacactaattcaaaaagt

SEQ ID NO: 46429 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acactaattcaaaaagtagg

SEQ ID NO: 46430 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gctatgtccacgcgatgcta

SEQ ID NO: 46431 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctatgtccacgcgatgctat

SEQ ID NO: 46432 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtccacgcgatgctataggc

SEQ ID NO: 46433 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cacgcgatgctataggccag

SEQ ID NO: 46434 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgatgctataggccagtggc

SEQ ID NO: 46435 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggctggaaaactttttcgta

SEQ ID NO: 46436 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gctggaaaactttttcgtaa

SEQ ID NO: 46437 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctggaaaactttttcgtaaa

SEQ ID NO: 46438 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gggccaaatgataaatattt

SEQ ID NO: 46439 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ataaatattttagactttat

SEQ ID NO: 46440 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taaatattttagactttatt

SEQ ID NO: 46441 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tattgggcatacgatttcta

SEQ ID NO: 46442 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgggcatacgatttctatgg

SEQ ID NO: 46443 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cctctgccactgtaatgtaa

SEQ ID NO: 46444 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgccactgtaatgtaaaag

SEQ ID NO: 46445 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgtaatgtaaaagcagtca

SEQ ID NO: 46446 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taatgtaaaagcagtcatag

SEQ ID NO: 46447 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gacattcctatgtttgaata

SEQ ID NO: 46448 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaaatgtaaaaatcattct

SEQ ID NO: 46449 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaaaatcattcttagctcc

SEQ ID NO: 46450 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaaatcattcttagctccc

SEQ ID NO: 46451 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaatcattcttagctccca

SEQ ID NO: 46452 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcccagggccacacaataa

SEQ ID NO: 46453 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcccagggccacacaataac

SEQ ID NO: 46454 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggccacacaataacaggcat

SEQ ID NO: 46455 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cacaataacaggcattggac

SEQ ID NO: 46456 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aacaggcattggactggctt

SEQ ID NO: 46457 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attggactggctttggtctg

SEQ ID NO: 46458 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttggactggctttggtctgt

SEQ ID NO: 46459 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tggactggctttggtctgtg

SEQ ID NO: 46460 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tggctttggtctgtggggca

SEQ ID NO: 46461 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggctttggtctgtggggcat

SEQ ID NO: 46462 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ataggtgctgatccttgcta

SEQ ID NO: 46463 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aggtgctgatccttgctata

SEQ ID NO: 46464 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggtgctgatccttgctatag

SEQ ID NO: 46465 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgatccttgctatagaggc

SEQ ID NO: 46466 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atagaggctagtcttacaca

SEQ ID NO: 46467 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctagtcttacacatggctat

SEQ ID NO: 46468 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tagtcttacacatggctata

SEQ ID NO: 46469 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ttacacatggctataaggtg

SEQ ID NO: 46470 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tacacatggctataaggtgc

SEQ ID NO: 46471 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atggctataaggtgcgggac

SEQ ID NO: 46472 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
accagtcctttcatttgcct

SEQ ID NO: 46473 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttaattatattttatttac

SEQ ID NO: 46474 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttatattttatttactagta

SEQ ID NO: 46475 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatttactagtatagcttc

SEQ ID NO: 46476 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atttactagtatagcttcaa

SEQ ID NO: 46477 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttactagtatagcttcaaga

SEQ ID NO: 46478 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatgccatcactttcaaaat

SEQ ID NO: 46479 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgccatcactttcaaaatta

SEQ ID NO: 46480 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cactttcaaaattagagaaa

SEQ ID NO: 46481 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttcaaaattagagaaaaaga

SEQ ID NO: 46482 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aacctttgccttaaaatgaa

SEQ ID NO: 46483 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acctttgccttaaaatgaat

SEQ ID NO: 46484 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttgccttaaaatgaatagg

SEQ ID NO: 46485 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gattttgaaaaatataaata

SEQ ID NO: 46486 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
attttgaaaaatataaatat

SEQ ID NO: 46487 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaatataaatatgggttatt

SEQ ID NO: 46488 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ataaatatgggttatttggc

SEQ ID NO: 46489 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taaatatgggttatttggct

SEQ ID NO: 46490 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcttttgcaattaataattg

SEQ ID NO: 46491 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttataaaattataaaaataa

SEQ ID NO: 46492 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcatcacaaaataatttcca

SEQ ID NO: 46493 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atcacaaaataatttccaca

SEQ ID NO: 46494 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aattaaaatgcatgaacatc

SEQ ID NO: 46495 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacatctggttacataccac

SEQ ID NO: 46496 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acatctggttacataccacc

SEQ ID NO: 46497 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgaccatcatgtaaacaat

SEQ ID NO: 46498 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgaccatcatgtaaacaata

SEQ ID NO: 46499 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catgtaaacaataaggcaca

SEQ ID NO: 46500 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aataaggcacatagcttgac

SEQ ID NO: 46501 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttgaccagcgacctccata

SEQ ID NO: 46502 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gacctccatacagtcccaca

SEQ ID NO: 46503 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtctctatccactctccaca

SEQ ID NO: 46504 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tccactctccacacagcacg

SEQ ID NO: 46505 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cacagcacgcggaacacaat

SEQ ID NO: 46506 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acagcacgcggaacacaatc

SEQ ID NO: 46507 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcacgcggaacacaatcagg

SEQ ID NO: 46508 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cacgcggaacacaatcagga

SEQ ID NO: 46509 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cgcggaacacaatcaggaag

SEQ ID NO: 46510 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggaacacaatcaggaaggag

SEQ ID NO: 46511 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acacaatcaggaaggagtgg

SEQ ID NO: 46512 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caatcaggaaggagtggaag

SEQ ID NO: 46513 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagtcgttcatgtgccaccg

SEQ ID NO: 46514 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agtcgttcatgtgccaccgt

SEQ ID NO: 46515 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcgttcatgtgccaccgtgg

SEQ ID NO: 46516 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtgccaccgtgggagcgta

SEQ ID NO: 46517 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tacagtcatcattgatcttg

SEQ ID NO: 46518 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcttgcagacacattctttg

SEQ ID NO: 46519 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attctttgtagctcttacca

SEQ ID NO: 46520 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctttgtagctcttaccaaa

SEQ ID NO: 46521 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaagagctgcatgccgacca

SEQ ID NO: 46522 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgccgaccacagcaaaaatg

SEQ ID NO: 46523 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agcaaaaatgaagacgatga

SEQ ID NO: 46524 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agacgatgatggccaacact

SEQ ID NO: 46525 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gacgatgatggccaacacta

SEQ ID NO: 46526 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgatggccaacactaaggt

SEQ ID NO: 46527 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgatggccaacactaaggtg

SEQ ID NO: 46528 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aacactaaggtgaggttacc

SEQ ID NO: 46529 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cactaaggtgaggttaccta

SEQ ID NO: 46530 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggttacctagagcccctact

SEQ ID NO: 46531 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagttaccaatgatcttaat

SEQ ID NO: 46532 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttaatcagcatgttcaatgt

SEQ ID NO: 46533 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcagcatgttcaatgttggc

SEQ ID NO: 46534 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagcatgttcaatgttggcc

SEQ ID NO: 46535 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gccaggattttgccaacttg

SEQ ID NO: 46536 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
attttgccaacttgaagact

SEQ ID NO: 46537 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttgccaacttgaagactcg

SEQ ID NO: 46538 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acttgaagactcggagctaa

SEQ ID NO: 46539 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cggagctaaaagcaaatata

SEQ ID NO: 46540 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccaatcttgatttttgttca

SEQ ID NO: 46541 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caatcttgatttttgttcaa

SEQ ID NO: 46542 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aatcttgatttttgttcaaa

SEQ ID NO: 46543 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgatttttgttcaaagggta

SEQ ID NO: 46544 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttttgttcaaagggtaaag

SEQ ID NO: 46545 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaagggtaaagcagacttt

SEQ ID NO: 46546 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ataatattgtcattattatc

SEQ ID NO: 46547 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaattacaacacatattatg

SEQ ID NO: 46548 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgaagaaactatgtacttt

SEQ ID NO: 46549 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaaactatgtacttttagtt

SEQ ID NO: 46550 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaactatgtacttttagttc

SEQ ID NO: 46551 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttttagttcaggattgcta

SEQ ID NO: 46552 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatttgtgatatttttcttt

SEQ ID NO: 46553 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cattttctcatgccgacact

SEQ ID NO: 46554 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gccgacacttagataaaatc

SEQ ID NO: 46555 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttagataaaatctagcatat

SEQ ID NO: 46556 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agataaaatctagcatatta

SEQ ID NO: 46557 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gataaaatctagcatattag

SEQ ID NO: 46558 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttagaggaatgtgctttaaa

SEQ ID NO: 46559 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatttgtttttatattgtt

SEQ ID NO: 46560 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtttttatattgttaagat

SEQ ID NO: 46561 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agatcagacaacaattgttt

SEQ ID NO: 46562 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gatcagacaacaattgtttt

SEQ ID NO: 46563 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atcagacaacaattgttttg

SEQ ID NO: 46564 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcagacaacaattgttttgg

SEQ ID NO: 46565 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctttaattaccaaattcata

SEQ ID NO: 46566 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tataatcattgaaattctgt

SEQ ID NO: 46567 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attgaaattctgtaagccac

SEQ ID NO: 46568 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaattattgtactatattaa

SEQ ID NO: 46569 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agaaaatatttatattatat

SEQ ID NO: 46570 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tattagcgtgtacttcaaat

SEQ ID NO: 46571 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtgtacttcaaattagaatt

SEQ ID NO: 46572 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaattgtaaaaatattcatg

SEQ ID NO: 46573 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaaaatattcatgtggttt

SEQ ID NO: 46574 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcatgtggttttagttcttt

SEQ ID NO: 46575 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taagtgcatttgtcaatgaa

SEQ ID NO: 46576 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgaatggattttattttac

SEQ ID NO: 46577 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attttattttactagatatc

SEQ ID NO: 46578 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttttgattcaaattcccaa

SEQ ID NO: 46579 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaaaaataatgcaaaacca

SEQ ID NO: 46580 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaagaaatacccctttatta

SEQ ID NO: 46581 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccctttattatagaatataa

SEQ ID NO: 46582 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atagaatataatggcaacct

SEQ ID NO: 46583 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caaccttagtttatgtttac

SEQ ID NO: 46584 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttaccagtctgaatgatcg

SEQ ID NO: 46585 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gacaatccttccacatctgc

SEQ ID NO: 46586 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atccttccacatctgctaga

SEQ ID NO: 46587 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccttccacatctgctagaaa

SEQ ID NO: 46588 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagagctccactaaactta

SEQ ID NO: 46589 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actaaacttaaagtcacaat

SEQ ID NO: 46590 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctaaacttaaagtcacaata

SEQ ID NO: 46591 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaggctgtcaaaaatattc

SEQ ID NO: 46592 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caaaaatattccagcctact

SEQ ID NO: 46593 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cctacttggaaatactcata

SEQ ID NO: 46594 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaaatactcatatggatcca

SEQ ID NO: 46595 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcatatggatccatggcaat

SEQ ID NO: 46596 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatcagttttaataccattt

SEQ ID NO: 46597 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaataccatttcagctgca

SEQ ID NO: 46598 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catttcagctgcaaagattc

SEQ ID NO: 46599 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagctgcaaagattccagta

SEQ ID NO: 46600 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagattccagtaaagacct

SEQ ID NO: 46601 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attccagtaaagacctaagt

SEQ ID NO: 46602 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taatgtttttctgttaatat

SEQ ID NO: 46603 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttctgttaatattagaaaa

SEQ ID NO: 46604 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttctgttaatattagaaaac

SEQ ID NO: 46605 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gataataatcactgtttgct

SEQ ID NO: 46606 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcttagcatttactgtgttc

SEQ ID NO: 46607 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agcatttactgtgttccaga

SEQ ID NO: 46608 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttgctaaatactttataaa

SEQ ID NO: 46609 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atggatattcttatctaact

SEQ ID NO: 46610 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctaacttagtcctgtaaat

SEQ ID NO: 46611 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctaacttagtcctgtaaatt

SEQ ID NO: 46612 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aattaggtattgctcttccc

SEQ ID NO: 46613 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcttccctggctcccatat

SEQ ID NO: 46614 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggctcccatatcagcatcaa

SEQ ID NO: 46615 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gctcccatatcagcatcaaa

SEQ ID NO: 46616 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atcagcatcaaaaggttgaa

SEQ ID NO: 46617 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaagctctaactgtcctgt

SEQ ID NO: 46618 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgtcagtgctcatcatttt

SEQ ID NO: 46619 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagtgctcatcatttttaga

SEQ ID NO: 46620 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atcatttttagacagcattt

SEQ ID NO: 46621 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttagacagcattttagaa

SEQ ID NO: 46622 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaatagcatattaaaattt

SEQ ID NO: 46623 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atagcatattaaaatttcag

SEQ ID NO: 46624 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agcatattaaaatttcagaa

SEQ ID NO: 46625 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttcagaagagtaaaacatt

SEQ ID NO: 46626 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaacatttggtaattgaca

SEQ ID NO: 46627 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgacacagtcactattttca

SEQ ID NO: 46628 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctattttcaaagaatttatg

SEQ ID NO: 46629 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tattttcaaagaatttatgt

SEQ ID NO: 46630 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagaatttatgtgggtcaaa

SEQ ID NO: 46631 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtgggtcaaaaagttgttc

SEQ ID NO: 46632 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gggtcaaaaagttgttctgg

SEQ ID NO: 46633 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcaaaaagttgttctggaag

SEQ ID NO: 46634 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgttctggaagaagataaa

SEQ ID NO: 46635 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaagataaaaagaaaacat

SEQ ID NO: 46636 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taagttgatactgaaatttt

SEQ ID NO: 46637 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgatactgaaattttgagc

SEQ ID NO: 46638 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttctgatctgactactgt

SEQ ID NO: 46639 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttctgatctgactactgtta

SEQ ID NO: 46640 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgactactgttagagtaata

SEQ ID NO: 46641 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acatgttgactcactcttta

SEQ ID NO: 46642 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcactctttaaagatttat

SEQ ID NO: 46643 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actctttaaagatttatcag

SEQ ID NO: 46644 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctttaaagatttatcagcag

SEQ ID NO: 46645 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttaaagatttatcagcagaa

SEQ ID NO: 46646 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttatcagcagaagagaaaa

SEQ ID NO: 46647 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaagtatttaattgacaatg

SEQ ID NO: 46648 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtatttaattgacaatgtgg

SEQ ID NO: 46649 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattgacaatgtggcagcta

SEQ ID NO: 46650 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagctaaagtaatacttcta

SEQ ID NO: 46651 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttctaaagctttgacacaa

SEQ ID NO: 46652 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atatcattaattcatgatac

SEQ ID NO: 46653 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattcatgatactggtatca

SEQ ID NO: 46654 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attcatgatactggtatcaa

SEQ ID NO: 46655 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatcaaaggactcacttaaa

SEQ ID NO: 46656 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atcaaaggactcacttaaaa

SEQ ID NO: 46657 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caacaccgaaatgaatcctt

SEQ ID NO: 46658 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aacaccgaaatgaatccttt

SEQ ID NO: 46659 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctttgggtacactttgactc

SEQ ID NO: 46660 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttgggtacactttgactca

SEQ ID NO: 46661 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgactcaaggaatctgacca

SEQ ID NO: 46662 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctcaaggaatctgaccaaag

SEQ ID NO: 46663 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atctgaccaaagaagattct

SEQ ID NO: 46664 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctgaccaaagaagattcta

SEQ ID NO: 46665 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctgaccaaagaagattctaa

SEQ ID NO: 46666 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagattctaagggaaatgtt

SEQ ID NO: 46667 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agattctaagggaaatgttt

SEQ ID NO: 46668 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatgtttaggtctataactg

SEQ ID NO: 46669 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgtttaggtctataactgc

SEQ ID NO: 46670 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtttaggtctataactgcag

SEQ ID NO: 46671 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagtcaattttcaaataatg

SEQ ID NO: 46672 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtcaattttcaaataatgc

SEQ ID NO: 46673 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttcaaataatgcaggatc

SEQ ID NO: 46674 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcaaataatgcaggatcaag

SEQ ID NO: 46675 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taatgcaggatcaagaagat

SEQ ID NO: 46676 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgcaggatcaagaagattgg

SEQ ID NO: 46677 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcaggatcaagaagattggc

SEQ ID NO: 46678 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caggatcaagaagattggca

SEQ ID NO: 46679 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggatcaagaagattggcagg

SEQ ID NO: 46680 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcaagaagattggcagggag

SEQ ID NO: 46681 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaagattggcagggagcagc

SEQ ID NO: 46682 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggcagggagcagctggactt

SEQ ID NO: 46683 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcagggagcagctggacttg

SEQ ID NO: 46684 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agcagctggacttgaggttg

SEQ ID NO: 46685 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tggacttgaggttgtggtaa

SEQ ID NO: 46686 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttgtggtaatagctgtgac

SEQ ID NO: 46687 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgtggtaatagctgtgacc

SEQ ID NO: 46688 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgaccaggtaaatcctttct

SEQ ID NO: 46689 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtaaatcctttctgagttca

SEQ ID NO: 46690 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taaatcctttctgagttcac

SEQ ID NO: 46691 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaatcctttctgagttcaca

SEQ ID NO: 46692 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttctgagttcacagggatg

SEQ ID NO: 46693 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcacagggatgcagtcgtct

SEQ ID NO: 46694 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agggatgcagtcgtctcagt

SEQ ID NO: 46695 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatgcagtcgtctcagtgag

SEQ ID NO: 46696 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgcagtcgtctcagtgaga

SEQ ID NO: 46697 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgagaaggtacttatttgc

SEQ ID NO: 46698 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aggtacttatttgcaagatc

SEQ ID NO: 46699 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tccggatctccaccaacaat

SEQ ID NO: 46700 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctccaccaacaattagaaac

SEQ ID NO: 46701 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatattcctgcctttttcca

SEQ ID NO: 46702 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgcctttttccaaagataaa

SEQ ID NO: 46703 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctttttccaaagataaatag

SEQ ID NO: 46704 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttttccaaagataaataga

SEQ ID NO: 46705 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttttccaaagataaatagaa

SEQ ID NO: 46706 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tccaaagataaatagaaggg

SEQ ID NO: 46707 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagataaatagaagggaag

SEQ ID NO: 46708 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agggaagaagaatgctaact

SEQ ID NO: 46709 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagaagaatgctaactcagc

SEQ ID NO: 46710 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgctaactcagcgagcaca

SEQ ID NO: 46711 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgctaactcagcgagcacat

SEQ ID NO: 46712 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gctaactcagcgagcacatg

SEQ ID NO: 46713 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gagcacatggggaaaaacat

SEQ ID NO: 46714 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agcacatggggaaaaacatt

SEQ ID NO: 46715 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaaacattgggaatatttg

SEQ ID NO: 46716 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gggaatatttgtagacaatt

SEQ ID NO: 46717 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatatttgtagacaatttag

SEQ ID NO: 46718 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgtagacaatttagaagaa

SEQ ID NO: 46719 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agacaatttagaagaaaaga

SEQ ID NO: 46720 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttagaagaaaagacagact

SEQ ID NO: 46721 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagaaaagacagactcagaa

SEQ ID NO: 46722 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cagactcagaaaagaacttc

SEQ ID NO: 46723 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcttcaaatgtcaatttgtt

SEQ ID NO: 46724 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cttcaaatgtcaatttgttt

SEQ ID NO: 46725 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtcaatttgtttgggacca

SEQ ID NO: 46726 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttgtttgggaccacagcaa

SEQ ID NO: 46727 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaagcaaaattatcttata

SEQ ID NO: 46728 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atcttatatagacattgaca

SEQ ID NO: 46729 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gacattgacaaagataccca

SEQ ID NO: 46730 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagatacccaaagttattca

SEQ ID NO: 46731 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagttattcatggtttatg

SEQ ID NO: 46732 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agttattcatggtttatgaa

SEQ ID NO: 46733 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catggtttatgaagagtcat

SEQ ID NO: 46734 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttatgaagagtcataagct

SEQ ID NO: 46735 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtcataagctgagattctc

SEQ ID NO: 46736 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctctggccctaaaaatgaac

SEQ ID NO: 46737 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tggtgcctgcctcacatcca

SEQ ID NO: 46738 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcacatccatagtcaaaaac

SEQ ID NO: 46739 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
actggcattttgtttaccct

SEQ ID NO: 46740 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcattttgtttaccctgagt

SEQ ID NO: 46741 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttaccctgagttagtgtgac

SEQ ID NO: 46742 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtgaccagcactgtacattt

SEQ ID NO: 46743 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaccagcactgtacatttta

SEQ ID NO: 46744 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtacattttagagatcactc

SEQ ID NO: 46745 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctggcatcaattttactaat

SEQ ID NO: 46746 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taattggatcttatatcttc

SEQ ID NO: 46747 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttggatcttatatcttccag

SEQ ID NO: 46748 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcaccttcttgcctatcctt

SEQ ID NO: 46749 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atccttgagtcttctatgtc

SEQ ID NO: 46750 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatgtccagttcaaccattt

SEQ ID NO: 46751 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
accattttggtttctcaaaa

SEQ ID NO: 46752 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctcaaaatagttgttttta

SEQ ID NO: 46753 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttttaaagcttgtttcatt

SEQ ID NO: 46754 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttgtttcattaagtctttg

SEQ ID NO: 46755 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatgatgttgatgatgatga

SEQ ID NO: 46756 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attgtgtatttactatatgc

SEQ ID NO: 46757 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgtgtatttactatatgcc

SEQ ID NO: 46758 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttactatatgccaggctaat

SEQ ID NO: 46759 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctatatgccaggctaataag

SEQ ID NO: 46760 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgccaggctaataagcaga

SEQ ID NO: 46761 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaaagcatttaatcctccc

SEQ ID NO: 46762 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaatatgataaatgaaata

SEQ ID NO: 46763 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaataattattttataatg

SEQ ID NO: 46764 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatgataaaattaaatacta

SEQ ID NO: 46765 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgataaaattaaatactaca

SEQ ID NO: 46766 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagagttaaaatatttgtcc

SEQ ID NO: 46767 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agagttaaaatatttgtcca

SEQ ID NO: 46768 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gagttaaaatatttgtccaa

SEQ ID NO: 46769 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggcatatcactcatataatg

SEQ ID NO: 46770 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcactcatataatgcagaat

SEQ ID NO: 46771 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcagaatcagcattcaaacc

SEQ ID NO: 46772 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagaatcagcattcaaaccc

SEQ ID NO: 46773 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agcattcaaacccaggactt

SEQ ID NO: 46774 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcattcaaacccaggacttt

SEQ ID NO: 46775 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acccaggactttgggactct

SEQ ID NO: 46776 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccaggactttgggactctg

SEQ ID NO: 46777 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acttcactactattatgtca

SEQ ID NO: 46778 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgtcaaagcaatacatcca

SEQ ID NO: 46779 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtcaaagcaatacatccat

SEQ ID NO: 46780 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taggttttctgaaaatatgt

SEQ ID NO: 46781 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aggttttctgaaaatatgtg

SEQ ID NO: 46782 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatgtgaggtgtgtacttac

SEQ ID NO: 46783 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaggtgtgtacttacaaga

SEQ ID NO: 46784 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggtgtgtacttacaagaaag

SEQ ID NO: 46785 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caagaaagcagcaatgtaat

SEQ ID NO: 46786 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagaaagcagcaatgtaatt

SEQ ID NO: 46787 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagcagcaatgtaattagg

SEQ ID NO: 46788 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagcagcaatgtaattagga

SEQ ID NO: 46789 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caatgtaattaggaaggtgt

SEQ ID NO: 46790 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtaattaggaaggtgtgaga

SEQ ID NO: 46791 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagaaagaaccaaaaatgtt

SEQ ID NO: 46792 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatgttaagtgttgctccc

SEQ ID NO: 46793 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gttgctcccaagaaatatgc

SEQ ID NO: 46794 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gctcccaagaaatatgctgg

SEQ ID NO: 46795 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaatcattatcaactccc

SEQ ID NO: 46796 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atcattatcaactcccaaga

SEQ ID NO: 46797 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cccaagatggtaacctttta

SEQ ID NO: 46798 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atggtaaccttttatagaaa

SEQ ID NO: 46799 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agaaatagtattgttatttg

SEQ ID NO: 46800 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgttatttgtagacctcaa

SEQ ID NO: 46801 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtactgcacaattattttaa

SEQ ID NO: 46802 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attattttaaaagacataac

SEQ ID NO: 46803 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
actctacacatccattcata

SEQ ID NO: 46804 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacacatccattcatatgga

SEQ ID NO: 46805 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tccattcatatggaaagttc

SEQ ID NO: 46806 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttctggatatgcataattct

SEQ ID NO: 46807 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctggatatgcataattctg

SEQ ID NO: 46808 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatgcataattctgaggctg

SEQ ID NO: 46809 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgacaatgatgacaactaaa

SEQ ID NO: 46810 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acaatgatgacaactaaaaa

SEQ ID NO: 46811 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caactaaaaagagaaactat

SEQ ID NO: 46812 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgagtacataacacacaat

SEQ ID NO: 46813 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gagtacataacacacaataa

SEQ ID NO: 46814 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagacttaccaaatttccta

SEQ ID NO: 46815 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttaccaaatttcctatagc

SEQ ID NO: 46816 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagtacatttttgaattcct

SEQ ID NO: 46817 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttttgaattcctcagtcat

SEQ ID NO: 46818 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttttgaattcctcagtcatt

SEQ ID NO: 46819 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgaattcctcagtcattggg

SEQ ID NO: 46820 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtcattgggtggtgttcca

SEQ ID NO: 46821 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtgtttaaaactatgcaaa

SEQ ID NO: 46822 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actatgcaaatggtaattgc

SEQ ID NO: 46823 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggtaattgcaagatctacaa

SEQ ID NO: 46824 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtaattgcaagatctacaaa

SEQ ID NO: 46825 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaggatccattacaataaaa

SEQ ID NO: 46826 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttttgaattttatccaata

SEQ ID NO: 46827 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttgaattttatccaatatg

SEQ ID NO: 46828 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgaattttatccaatatgga

SEQ ID NO: 46829 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tccaatatggagagcaattc

SEQ ID NO: 46830 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atggagagcaattccagatc

SEQ ID NO: 46831 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgtgcaaatctgtaccacc

SEQ ID NO: 46832 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtgcaaatctgtaccacca

SEQ ID NO: 46833 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcaaatctgtaccaccaagg

SEQ ID NO: 46834 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccaaggtggacatttttgtc

SEQ ID NO: 46835 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catttttgtctggactcttc

SEQ ID NO: 46836 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtctggactcttcaagttc

SEQ ID NO: 46837 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtctggactcttcaagttct

SEQ ID NO: 46838 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctggactcttcaagttctgg

SEQ ID NO: 46839 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttcaagttctgggagaaaa

SEQ ID NO: 46840 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caagttctgggagaaaaaag

SEQ ID NO: 46841 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agttctgggagaaaaaagca

SEQ ID NO: 46842 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggagaaaaaagcagagaaca

SEQ ID NO: 46843 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaaaaaagcagagaacatg

SEQ ID NO: 46844 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaagcagagaacatggagt

SEQ ID NO: 46845 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgtctgtttcactcctaac

SEQ ID NO: 46846 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actcctaaccagatacaaat

SEQ ID NO: 46847 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctaaccagatacaaatcagt

SEQ ID NO: 46848 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taaccagatacaaatcagtc

SEQ ID NO: 46849 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggcattctaatattgaaac

SEQ ID NO: 46850 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggcattctaatattgaaaca

SEQ ID NO: 46851 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taatattgaaacaaggttta

SEQ ID NO: 46852 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgaaacaaggtttatagtt

SEQ ID NO: 46853 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttagattttgaaaatttaa

SEQ ID NO: 46854 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taacagtactatttcaatga

SEQ ID NO: 46855 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtactatttcaatgaaagca

SEQ ID NO: 46856 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaagcatagcctcttatgt

SEQ ID NO: 46857 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attatgacatgttcgttgcc

SEQ ID NO: 46858 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acatgttcgttgcctagatg

SEQ ID NO: 46859 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcgttgcctagatgaagcat

SEQ ID NO: 46860 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gttgcctagatgaagcataa

SEQ ID NO: 46861 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgcctagatgaagcataaga

SEQ ID NO: 46862 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcctagatgaagcataagag

SEQ ID NO: 46863 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctagatgaagcataagaga

SEQ ID NO: 46864 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatgaagcataagagagggt

SEQ ID NO: 46865 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgaagcataagagagggta

SEQ ID NO: 46866 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagcataagagagggtaagg

SEQ ID NO: 46867 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaagtgaaatttatgactgc

SEQ ID NO: 46868 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatgactgcaagcacatatg

SEQ ID NO: 46869 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgactgcaagcacatatgt

SEQ ID NO: 46870 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcacatatgtgggcatcttt

SEQ ID NO: 46871 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acatatgtgggcatctttca

SEQ ID NO: 46872 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaatgcacctaacatgtga

SEQ ID NO: 46873 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acctaacatgtgatggtaaa

SEQ ID NO: 46874 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cctaacatgtgatggtaaac

SEQ ID NO: 46875 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taacatgtgatggtaaacag

SEQ ID NO: 46876 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggagaactatgtttccttaa

SEQ ID NO: 46877 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaactatgtttccttaaca

SEQ ID NO: 46878 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atatttttcacctgtgtttt

SEQ ID NO: 46879 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttagtcccatgacaacaat

SEQ ID NO: 46880 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcccatgacaacaataagat

SEQ ID NO: 46881 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taagatgagactattctgtc

SEQ ID NO: 46882 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agaaaaaactcttgctgtaa

SEQ ID NO: 46883 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actcttgctgtaatagttca

SEQ ID NO: 46884 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctcttgctgtaatagttcac

SEQ ID NO: 46885 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttcacaggtgaaaacaatcc

SEQ ID NO: 46886 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgaaaacaatcctagaacc

SEQ ID NO: 46887 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caatcctagaaccaagcaac

SEQ ID NO: 46888 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagcaactagaaataattta

SEQ ID NO: 46889 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcaactagaaataatttatg

SEQ ID NO: 46890 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caactagaaataatttatgg

SEQ ID NO: 46891 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttatggaggactcatgaaa

SEQ ID NO: 46892 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatagacatttcacaccat

SEQ ID NO: 46893 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttacttctcaccatttatt

SEQ ID NO: 46894 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttacttctcaccatttattt

SEQ ID NO: 46895 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acttctcaccatttatttag

SEQ ID NO: 46896 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcaccatttatttaggagat

SEQ ID NO: 46897 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccatttatttaggagatgag

SEQ ID NO: 46898 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagacactttgcccccacaa

SEQ ID NO: 46899 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agacactttgcccccacaat

SEQ ID NO: 46900 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgcccccacaatgggaatg

SEQ ID NO: 46901 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgcccccacaatgggaatgt

SEQ ID NO: 46902 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcccccacaatgggaatgtg

SEQ ID NO: 46903 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cccccacaatgggaatgtgg

SEQ ID NO: 46904 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccccacaatgggaatgtggg

SEQ ID NO: 46905 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caatgggaatgtggggggtg

SEQ ID NO: 46906 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaatgtggggggtgaagtgt

SEQ ID NO: 46907 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggggggtgaagtgttagacc

SEQ ID NO: 46908 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gggggtgaagtgttagaccc

SEQ ID NO: 46909 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggggtgaagtgttagaccca

SEQ ID NO: 46910 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaagtgttagacccagggac

SEQ ID NO: 46911 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagtgttagacccagggacc

SEQ ID NO: 46912 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgttagacccagggaccagg

SEQ ID NO: 46913 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gttagacccagggaccaggt

SEQ ID NO: 46914 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cccagggaccaggtgggacc

SEQ ID NO: 46915 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccagggaccaggtgggacct

SEQ ID NO: 46916 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cagggaccaggtgggacctg

SEQ ID NO: 46917 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgggacctggggcatattgt

SEQ ID NO: 46918 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gggacctggggcatattgtc

SEQ ID NO: 46919 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggacctggggcatattgtca

SEQ ID NO: 46920 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gacctggggcatattgtcag

SEQ ID NO: 46921 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cctggggcatattgtcaggg

SEQ ID NO: 46922 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggggcatattgtcagggga

SEQ ID NO: 46923 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggggcatattgtcaggggag

SEQ ID NO: 46924 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gggcatattgtcaggggaga

SEQ ID NO: 46925 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catattgtcaggggagaggg

SEQ ID NO: 46926 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attgtcaggggagagggtag

SEQ ID NO: 46927 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcaggggagagggtagaagc

SEQ ID NO: 46928 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggagagggtagaagccagca

SEQ ID NO: 46929 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaagccagcacagtttgta

SEQ ID NO: 46930 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctttgactatctttgcttat

SEQ ID NO: 46931 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgactatctttgcttattag

SEQ ID NO: 46932 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
actatctttgcttattagaa

SEQ ID NO: 46933 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tattagaagagacaattttt

SEQ ID NO: 46934 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgagcgaatatgtaatttgt

SEQ ID NO: 46935 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgtaatttgtaagattata

SEQ ID NO: 46936 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttgtaagattatatagtga

SEQ ID NO: 46937 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatatagtgacagaatcacg

SEQ ID NO: 46938 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtgacagaatcacgtagctc

SEQ ID NO: 46939 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgacagaatcacgtagctct

SEQ ID NO: 46940 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attaaatcacttatctttga

SEQ ID NO: 46941 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttaaatcacttatctttgaa

SEQ ID NO: 46942 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atcacttatctttgaaaggt

SEQ ID NO: 46943 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcacccaacatctgtctttg

SEQ ID NO: 46944 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cacccaacatctgtctttgt

SEQ ID NO: 46945 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttctttttttcattttgca

SEQ ID NO: 46946 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttatcaatgtctgtgtttaa

SEQ ID NO: 46947 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaataattttatccattttt

SEQ ID NO: 46948 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcacataaaaacaattccat

SEQ ID NO: 46949 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaattccatcagtatccat

SEQ ID NO: 46950 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catcatttaaaaccatttta

SEQ ID NO: 46951 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atggtctctgaattcttcct

SEQ ID NO: 46952 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaatttcatgtgcctattt

SEQ ID NO: 46953 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaatttcatgtgcctattta

SEQ ID NO: 46954 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtgcctatttaaggttgac

SEQ ID NO: 46955 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatttatgttaattttattt

SEQ ID NO: 46956 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attttatttaagaatctgta

SEQ ID NO: 46957 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttaagaatctgtacagtaa

SEQ ID NO: 46958 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagaatctgtacagtaaaag

SEQ ID NO: 46959 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agattattacataccttcca

SEQ ID NO: 46960 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctactcattgctctctgtct

SEQ ID NO: 46961 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tactcattgctctctgtctg

SEQ ID NO: 46962 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cattgctctctgtctgaggt

SEQ ID NO: 46963 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
attgctctctgtctgaggtt

SEQ ID NO: 46964 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtctgaggttgggatcatt

SEQ ID NO: 46965 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcattcagcatatcctctga

SEQ ID NO: 46966 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cattcagcatatcctctgaa

SEQ ID NO: 46967 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttcagcatatcctctgaaag

SEQ ID NO: 46968 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcatatcctctgaaaggaga

SEQ ID NO: 46969 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catatcctctgaaaggagat

SEQ ID NO: 46970 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccttttcttgtgtatttgat

SEQ ID NO: 46971 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaaatcaattaatgtctt

SEQ ID NO: 46972 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atcaattaatgtcttaagaa

SEQ ID NO: 46973 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aacagaatcctaataaattg

SEQ ID NO: 46974 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acagaatcctaataaattgt

SEQ ID NO: 46975 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcctaataaattgtaggtat

SEQ ID NO: 46976 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagataaaatcttgcttata

SEQ ID NO: 46977 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatcttgcttatatagctg

SEQ ID NO: 46978 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cttgcttatatagctgtagt

SEQ ID NO: 46979 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagctgtagtgagtaattaa

SEQ ID NO: 46980 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgtagtgagtaattaaaag

SEQ ID NO: 46981 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtagtgagtaattaaaagta

SEQ ID NO: 46982 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagtaattaaaagtagagcc

SEQ ID NO: 46983 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaagtagagcctagattgc

SEQ ID NO: 46984 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaagtagagcctagattgct

SEQ ID NO: 46985 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agattgctgggttcaaatta

SEQ ID NO: 46986 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attatggctctgctacttac

SEQ ID NO: 46987 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacttactggctgtatatca

SEQ ID NO: 46988 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acttactggctgtatatcat

SEQ ID NO: 46989 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttactggctgtatatcatag

SEQ ID NO: 46990 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
actggctgtatatcatagga

SEQ ID NO: 46991 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggagagctacttaactgtct

SEQ ID NO: 46992 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taactgtctcagttttatat

SEQ ID NO: 46993 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcagttttatattggtaaaa

SEQ ID NO: 46994 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cagttttatattggtaaaat

SEQ ID NO: 46995 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agttttatattggtaaaatg

SEQ ID NO: 46996 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tggtaaaatggggataatca

SEQ ID NO: 46997 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgcttgcttcatattcttgt

SEQ ID NO: 46998 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcttgcttcatattcttgtg

SEQ ID NO: 46999 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcatattcttgtgaggatta

SEQ ID NO: 47000 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catattcttgtgaggattaa

SEQ ID NO: 47001 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttaaaggaattaatatttat

SEQ ID NO: 47002 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatttatgagataaaaaata

SEQ ID NO: 47003 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatgagataaaaaataaagc

SEQ ID NO: 47004 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
catcacctctctgcctttct

SEQ ID NO: 47005 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttctgagtgttcaatttatt

SEQ ID NO: 47006 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagtgttcaatttattcaga

SEQ ID NO: 47007 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcagatagtttgtcatgtga

SEQ ID NO: 47008 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtgacagtcctacatgaaaa

SEQ ID NO: 47009 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtcctacatgaaaacagtga

SEQ ID NO: 47010 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgaaaacagtgaaagtgctg

SEQ ID NO: 47011 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gctgtagtgctgtgtatcta

SEQ ID NO: 47012 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctgtagtgctgtgtatctaa

SEQ ID NO: 47013 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgtagtgctgtgtatctaaa

SEQ ID NO: 47014 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtagtgctgtgtatctaaag

SEQ ID NO: 47015 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtgctgtgtatctaaagggg

SEQ ID NO: 47016 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatctaaaggggtagaatct

SEQ ID NO: 47017 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtattctctgataaatttc

SEQ ID NO: 47018 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttctggaattactttttatt

SEQ ID NO: 47019 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctggaattactttttattg

SEQ ID NO: 47020 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctggaattactttttattga

SEQ ID NO: 47021 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgagggaacaacattaatg

SEQ ID NO: 47022 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cattaatgaagctcctgtaa

SEQ ID NO: 47023 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatggttgtctcttactgcc

SEQ ID NO: 47024 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atggttgtctcttactgcca

SEQ ID NO: 47025 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttgtctcttactgccaagg

SEQ ID NO: 47026 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caaggaagacctcatgaact

SEQ ID NO: 47027 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggaagacctcatgaactgag

SEQ ID NO: 47028 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagacctcatgaactgagca

SEQ ID NO: 47029 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcatatgatgataaatgact

SEQ ID NO: 47030 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgataaatgactcagtttga

SEQ ID NO: 47031 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gataaatgactcagtttgaa

SEQ ID NO: 47032 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctcagtttgaaaggaacaat

SEQ ID NO: 47033 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaaaggaacaattagtgaaa

SEQ ID NO: 47034 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaggaacaattagtgaaatg

SEQ ID NO: 47035 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attagtgaaatggagaatgc

SEQ ID NO: 47036 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaatgcaagctacatctga

SEQ ID NO: 47037 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatgcaagctacatctgaaa

SEQ ID NO: 47038 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgcaagctacatctgaaag

SEQ ID NO: 47039 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgaaagaggtgacctctctt

SEQ ID NO: 47040 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aggtgacctctcttcagctc

SEQ ID NO: 47041 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacatgaactcatgcataac

SEQ ID NO: 47042 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acaagtgtatttatttttgt

SEQ ID NO: 47043 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatgtcttatttttaaaact

SEQ ID NO: 47044 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcaaatttaaaacactatgt

SEQ ID NO: 47045 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacactatgttggttccatg

SEQ ID NO: 47046 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acactatgttggttccatgc

SEQ ID NO: 47047 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatgttggttccatgcaggc

SEQ ID NO: 47048 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cacaaacaactatacaactc

SEQ ID NO: 47049 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catgtttgtctgcttgtgtg

SEQ ID NO: 47050 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtctgcttgtgtgtggtatg

SEQ ID NO: 47051 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atattttaaatatatatttc

SEQ ID NO: 47052 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatatatttctagatttgta

SEQ ID NO: 47053 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctagatttgtaaagttgta

SEQ ID NO: 47054 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtaaagttgtatagttgta

SEQ ID NO: 47055 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtaaagttgtatagttgtat

SEQ ID NO: 47056 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttgtatagttgtataggta

SEQ ID NO: 47057 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catgtatgtgtatcaaaaca

SEQ ID NO: 47058 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtatcaaaacacagacata

SEQ ID NO: 47059 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtatcaaaacacagacatac

SEQ ID NO: 47060 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaacacagacatacaggca

SEQ ID NO: 47061 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tacaggcatagatatgtgca

SEQ ID NO: 47062 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acaggcatagatatgtgcat

SEQ ID NO: 47063 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgcatctatgtgtatgtgaa

SEQ ID NO: 47064 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtgaacagacacacccattt

SEQ ID NO: 47065 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaacagacacacccatttga

SEQ ID NO: 47066 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atttgagagatctctgtaaa

SEQ ID NO: 47067 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaaagtcaactttttgaa

SEQ ID NO: 47068 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttttgaaaagtctcgaaaac

SEQ ID NO: 47069 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttgaaaagtctcgaaaacc

SEQ ID NO: 47070 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaccaggttttctgtgcta

SEQ ID NO: 47071 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtgctatagtctgtcaaac

SEQ ID NO: 47072 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctgtcaaacaagaatttgt

SEQ ID NO: 47073 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaacaaattattttccatg

SEQ ID NO: 47074 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttttccatgtagacatgttt

SEQ ID NO: 47075 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttccatgtagacatgtttc

SEQ ID NO: 47076 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgtagacatgtttcaggta

SEQ ID NO: 47077 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtagacatgtttcaggtata

SEQ ID NO: 47078 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aggtatagagatgacgttat

SEQ ID NO: 47079 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agatgacgttattagttatg

SEQ ID NO: 47080 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtatttccattgtatcttat

SEQ ID NO: 47081 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taagtatccactaattcctc

SEQ ID NO: 47082 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cactaattcctctagttttg

SEQ ID NO: 47083 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tagttttgtagttttcactt

SEQ ID NO: 47084 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agttttgtagttttcacttt

SEQ ID NO: 47085 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgtgatactgatttttcta

SEQ ID NO: 47086 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggtgaaaaaactcttaaatg

SEQ ID NO: 47087 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctaatctgatataaattata

SEQ ID NO: 47088 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataattgcaaaacaaaatgc

SEQ ID NO: 47089 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcaaaacaaaatgcaagca

SEQ ID NO: 47090 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcaagcaaagtttgattcca

SEQ ID NO: 47091 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caataatgaaaaataccttg

SEQ ID NO: 47092 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taatgaaaaataccttgcag

SEQ ID NO: 47093 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatgaaaaataccttgcaga

SEQ ID NO: 47094 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgaaaaataccttgcagaa

SEQ ID NO: 47095 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aataccttgcagaagggctt

SEQ ID NO: 47096 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taagctgtatcatgcacaca

SEQ ID NO: 47097 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agctgtatcatgcacacata

SEQ ID NO: 47098 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gctgtatcatgcacacatag

SEQ ID NO: 47099 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaggtcacatgttacctaa

SEQ ID NO: 47100 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcaaattgaaatatatgtg

SEQ ID NO: 47101 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgaaatatatgtgtggcca

SEQ ID NO: 47102 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgtgtggccatggatttga

SEQ ID NO: 47103 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtctgcaaatataaatatat

SEQ ID NO: 47104 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatataaatatataagcatg

SEQ ID NO: 47105 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagcatgtagcatatgtttg

SEQ ID NO: 47106 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agcatatgtttgaagcttat

SEQ ID NO: 47107 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcatatgtttgaagcttatt

SEQ ID NO: 47108 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgtttgaagcttattgggt

SEQ ID NO: 47109 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaagcttattgggttagtca

SEQ ID NO: 47110 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtcaaagcccttgctgatat

SEQ ID NO: 47111 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccttgctgatattggtaatg

SEQ ID NO: 47112 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgatattggtaatgcagca

SEQ ID NO: 47113 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attggtaatgcagcatagca

SEQ ID NO: 47114 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtaatgcagcatagcatagt

SEQ ID NO: 47115 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgcagcatagcatagtgag

SEQ ID NO: 47116 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgcagcatagcatagtgagt

SEQ ID NO: 47117 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atagcatagtgagtgggcta

SEQ ID NO: 47118 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agcatagtgagtgggctaaa

SEQ ID NO: 47119 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agtgggctaaagagatatcc

SEQ ID NO: 47120 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagagatatcctggaaactc

SEQ ID NO: 47121 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agagatatcctggaaactcc

SEQ ID NO: 47122 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atcctggaaactccaggaat

SEQ ID NO: 47123 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggaaactccaggaatgaga

SEQ ID NO: 47124 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgagaaagatctcactttc

SEQ ID NO: 47125 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atctcactttcaagcctaat

SEQ ID NO: 47126 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gacacctttctctaaccact

SEQ ID NO: 47127 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctaaccacttagtgactcg

SEQ ID NO: 47128 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cttagtgactcgtagacctt

SEQ ID NO: 47129 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgtgtcaatgcttgcattt

SEQ ID NO: 47130 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agatattttgttttgattca

SEQ ID NO: 47131 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgttttgattcatagactc

SEQ ID NO: 47132 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atattttttaaaaatgaaaa

SEQ ID NO: 47133 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acagttatgtttcatttata

SEQ ID NO: 47134 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agttatgtttcatttatatg

SEQ ID NO: 47135 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gttatgtttcatttatatgg

SEQ ID NO: 47136 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatatggaggacctaataca

SEQ ID NO: 47137 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagccattctaaattttttc

SEQ ID NO: 47138 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attctaaattttttcaagat

SEQ ID NO: 47139 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctaaattttttcaagataag

SEQ ID NO: 47140 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ataagaagcctactgcacat

SEQ ID NO: 47141 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagaagcctactgcacattg

SEQ ID NO: 47142 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaagcctactgcacattgga

SEQ ID NO: 47143 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cctactgcacattggagaga

SEQ ID NO: 47144 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actgcacattggagagatag

SEQ ID NO: 47145 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgcacattggagagatagca

SEQ ID NO: 47146 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cattggagagatagcagagt

SEQ ID NO: 47147 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggagagatagcagagtgag

SEQ ID NO: 47148 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agatagcagagtgagtggtt

SEQ ID NO: 47149 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atagcagagtgagtggttaa

SEQ ID NO: 47150 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagtgagtggttaagagcac

SEQ ID NO: 47151 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taagagcacaagatctgaaa

SEQ ID NO: 47152 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agcacaagatctgaaacaga

SEQ ID NO: 47153 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agacagcctccgtttcaact

SEQ ID NO: 47154 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gacagcctccgtttcaactt

SEQ ID NO: 47155 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagcctccgtttcaacttag

SEQ ID NO: 47156 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acttaggagctaccatttat

SEQ ID NO: 47157 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggagctaccatttattagct

SEQ ID NO: 47158 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catttattagctgagtaaat

SEQ ID NO: 47159 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atttattagctgagtaaatt

SEQ ID NO: 47160 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttattagctgagtaaattg

SEQ ID NO: 47161 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttagctgagtaaattggggc

SEQ ID NO: 47162 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caattttcccatttgtaaaa

SEQ ID NO: 47163 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attttcccatttgtaaaaca

SEQ ID NO: 47164 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gataataatgtatcatctca

SEQ ID NO: 47165 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ataataatgtatcatctcat

SEQ ID NO: 47166 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taataatgtatcatctcatg

SEQ ID NO: 47167 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgttattaacaactcaaat

SEQ ID NO: 47168 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaactcaaataagattcct

SEQ ID NO: 47169 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcaaataagattccttggaa

SEQ ID NO: 47170 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caaataagattccttggaat

SEQ ID NO: 47171 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccttggaataggtacatatt

SEQ ID NO: 47172 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tattaagctgtgacctgaaa

SEQ ID NO: 47173 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagctgtgacctgaaaaaga

SEQ ID NO: 47174 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgtgacctgaaaaagatag

SEQ ID NO: 47175 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgacctgaaaaagatagcag

SEQ ID NO: 47176 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctgaaaaagatagcagtagc

SEQ ID NO: 47177 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaagatagcagtagctggc

SEQ ID NO: 47178 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagtaatccaaatttcttca

SEQ ID NO: 47179 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tccaaatttcttcatagaaa

SEQ ID NO: 47180 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccaaatttcttcatagaaat

SEQ ID NO: 47181 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gatctattattaactaatat

SEQ ID NO: 47182 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccgtcataaattgttctcta

SEQ ID NO: 47183 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtcataaattgttctctaaa

SEQ ID NO: 47184 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atcttcaattataaaattaa

SEQ ID NO: 47185 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caattataaaattaatagac

SEQ ID NO: 47186 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caagtacctttttacaaaaa

SEQ ID NO: 47187 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aagtacctttttacaaaaat

SEQ ID NO: 47188 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaaatgggattttatcttt

SEQ ID NO: 47189 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgggattttatctttgagt

SEQ ID NO: 47190 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agttagatgcctacaacaca

SEQ ID NO: 47191 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgcctacaacacatagaat

SEQ ID NO: 47192 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgcctacaacacatagaatg

SEQ ID NO: 47193 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acaacacatagaatgaggat

SEQ ID NO: 47194 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caacacatagaatgaggatt

SEQ ID NO: 47195 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggattaggctaatgaatca

SEQ ID NO: 47196 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggattaggctaatgaatcaa

SEQ ID NO: 47197 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaatcaaaggtgtgttccta

SEQ ID NO: 47198 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaggtgtgttcctatagaaa

SEQ ID NO: 47199 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaaaaagtattgcaaaatg

SEQ ID NO: 47200 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaaagtattgcaaaatgca

SEQ ID NO: 47201 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaaatgcagagccattcac

SEQ ID NO: 47202 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgcagagccattcacaagac

SEQ ID NO: 47203 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagagccattcacaagacca

SEQ ID NO: 47204 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agccattcacaagaccagag

SEQ ID NO: 47205 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gccattcacaagaccagaga

SEQ ID NO: 47206 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caagaccagagaaggccctt

SEQ ID NO: 47207 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaccagagaaggcccttcag

SEQ ID NO: 47208 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccagagaaggcccttcagca

SEQ ID NO: 47209 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agagaaggcccttcagcaga

SEQ ID NO: 47210 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agcagagagactgactgatg

SEQ ID NO: 47211 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcagagagactgactgatgc

SEQ ID NO: 47212 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agactgactgatgcaggaac

SEQ ID NO: 47213 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gactgactgatgcaggaaca

SEQ ID NO: 47214 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
actgactgatgcaggaacaa

SEQ ID NO: 47215 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgatgcaggaacaagggcc

SEQ ID NO: 47216 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acaagggcccagccatgcct

SEQ ID NO: 47217 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaacgtccttacgctgtcat

SEQ ID NO: 47218 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cgtccttacgctgtcatcag

SEQ ID NO: 47219 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gccttatctattatcacctc

SEQ ID NO: 47220 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttatctattatcacctctgg

SEQ ID NO: 47221 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctattatcacctctggcag

SEQ ID NO: 47222 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctctggcagaagctgtccat

SEQ ID NO: 47223 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tctggcagaagctgtccatt

SEQ ID NO: 47224 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctggcagaagctgtccattg

SEQ ID NO: 47225 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggcagaagctgtccattggg

SEQ ID NO: 47226 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agctgtccattggggagcat

SEQ ID NO: 47227 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gctgtccattggggagcatg

SEQ ID NO: 47228 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctgtccattggggagcatga

SEQ ID NO: 47229 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cattggggagcatgagggct

SEQ ID NO: 47230 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agggctgagcgtccatcaac

SEQ ID NO: 47231 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gggctgagcgtccatcaacc

SEQ ID NO: 47232 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggctgagcgtccatcaacca

SEQ ID NO: 47233 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgagcgtccatcaaccagg

SEQ ID NO: 47234 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccagggagaccacaccgttg

SEQ ID NO: 47235 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaccacaccgttgcagtcca

SEQ ID NO: 47236 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ctgtgcattttcccgttcac

SEQ ID NO: 47237 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgcattttcccgttcaccgg

SEQ ID NO: 47238 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcccgttcaccggcagcat

SEQ ID NO: 47239 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccgttcaccggcagcattgg

SEQ ID NO: 47240 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cgttcaccggcagcattggt

SEQ ID NO: 47241 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gttcaccggcagcattggtg

SEQ ID NO: 47242 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cagcattggtggggacctac

SEQ ID NO: 47243 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttggtggggacctactggct

SEQ ID NO: 47244 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgttactgctgcgtcgctcc

SEQ ID NO: 47245 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gttactgctgcgtcgctcct

SEQ ID NO: 47246 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttactgctgcgtcgctcctg

SEQ ID NO: 47247 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgcgtcgctcctggggtctg

SEQ ID NO: 47248 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcgtcgctcctggggtctgt

SEQ ID NO: 47249 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cgtcgctcctggggtctgtg

SEQ ID NO: 47250 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tggggtctgtggggcacaaa

SEQ ID NO: 47251 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtctgtggggcacaaacagt

SEQ ID NO: 47252 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aaaaatgctgtgctcatcat

SEQ ID NO: 47253 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtgctcatcatcggcaaatt

SEQ ID NO: 47254 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atcatcggcaaattcagtct

SEQ ID NO: 47255 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cctctgcctttgaaactaaa

SEQ ID NO: 47256 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgttctgctgcttcgccttg

SEQ ID NO: 47257 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcttcgccttgcagaaaac

SEQ ID NO: 47258 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcttcgccttgcagaaaaca

SEQ ID NO: 47259 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttcgccttgcagaaaacaag

SEQ ID NO: 47260 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aacaaggagccacgaatgct

SEQ ID NO: 47261 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaggagccacgaatgctgag

SEQ ID NO: 47262 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cgaatgctgagtggtgactg

SEQ ID NO: 47263 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cagaaaaattaaaaaaaacg

SEQ ID NO: 47264 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaaaaaacgtggttgctg

SEQ ID NO: 47265 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttgctgaagcacctactga

SEQ ID NO: 47266 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gctgaagcacctactgatag

SEQ ID NO: 47267 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ataaataccactgaacccac

SEQ ID NO: 47268 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
accactgaacccactggcct

SEQ ID NO: 47269 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccactgaacccactggcctg

SEQ ID NO: 47270 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cactgaacccactggcctga

SEQ ID NO: 47271 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgaacccactggcctgaggg

SEQ ID NO: 47272 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaacccactggcctgagggc

SEQ ID NO: 47273 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cccactggcctgagggcagg

SEQ ID NO: 47274 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtggctctgtactgacttaa

SEQ ID NO: 47275 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagaaacatacttaaaaacg

SEQ ID NO: 47276 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tacttaaaaacgaagcaatt

SEQ ID NO: 47277 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taaaaacgaagcaattcagt

SEQ ID NO: 47278 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaacgaagcaattcagtgag

SEQ ID NO: 47279 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaagaaaacttcttccactt

SEQ ID NO: 47280 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagaaaacttcttccactta

SEQ ID NO: 47281 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agaaaacttcttccacttaa

SEQ ID NO: 47282 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttaagggatgaaacaatttg

SEQ ID NO: 47283 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atttgtagaattcatccttt

SEQ ID NO: 47284 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttgtagaattcatcctttc

SEQ ID NO: 47285 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaattcatcctttcaggac

SEQ ID NO: 47286 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaattcatcctttcaggacc

SEQ ID NO: 47287 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtaaattatttgttgctata

SEQ ID NO: 47288 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatacagctctctaatattc

SEQ ID NO: 47289 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agctctctaatattctggcc

SEQ ID NO: 47290 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctctctaatattctggccta

SEQ ID NO: 47291 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgccattcattttgctgca

SEQ ID NO: 47292 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagaacttataacttaaaaa

SEQ ID NO: 47293 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tataacttaaaaaaagaact

SEQ ID NO: 47294 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaagaacttagtattgctac

SEQ ID NO: 47295 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actttttatatatcaatccc

SEQ ID NO: 47296 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctttttatatatcaatcccc

SEQ ID NO: 47297 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cccaggcttcacaaaaaaat

SEQ ID NO: 47298 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaattggaaatcatgctgta

SEQ ID NO: 47299 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaaatccaccttacatact

SEQ ID NO: 47300 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaatccaccttacatactaa

SEQ ID NO: 47301 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caccttacatactaagagct

SEQ ID NO: 47302 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acatactaagagctcagtta

SEQ ID NO: 47303 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gctcagttaaagtgtattta

SEQ ID NO: 47304 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcagttaaagtgtatttaaa

SEQ ID NO: 47305 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agttaaagtgtatttaaaga

SEQ ID NO: 47306 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtgtatttaaagagagcttt

SEQ ID NO: 47307 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttaaagagagcttttagcac

SEQ ID NO: 47308 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttagcaccagttaatttata

SEQ ID NO: 47309 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagtcattaaatatttaaa

SEQ ID NO: 47310 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtcattaaatatttaaaaag

SEQ ID NO: 47311 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagaagttgcccaatacca

SEQ ID NO: 47312 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaagttgcccaataccaaa

SEQ ID NO: 47313 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaagttgcccaataccaaag

SEQ ID NO: 47314 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agttgcccaataccaaagag

SEQ ID NO: 47315 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gttgcccaataccaaagagg

SEQ ID NO: 47316 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgcttatatgactcatgtc

SEQ ID NO: 47317 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgcttatatgactcatgtcc

SEQ ID NO: 47318 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcttatatgactcatgtcca

SEQ ID NO: 47319 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtccagggtgtaaatcctt

SEQ ID NO: 47320 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccagggtgtaaatcctttgg

SEQ ID NO: 47321 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagggtgtaaatcctttgga

SEQ ID NO: 47322 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtaaatcctttggaaggatc

SEQ ID NO: 47323 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttggaaggatctagttcaa

SEQ ID NO: 47324 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggatctagttcaatagacat

SEQ ID NO: 47325 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acattagtgcttactatgta

SEQ ID NO: 47326 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcttactatgtaaagaaca

SEQ ID NO: 47327 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttactatgtaaagaacaaag

SEQ ID NO: 47328 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtggcaactattgtgaacaa

SEQ ID NO: 47329 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actattgtgaacaatggaaa

SEQ ID NO: 47330 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtgaacaatggaaaaagta

SEQ ID NO: 47331 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacaatggaaaaagtatggt

SEQ ID NO: 47332 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acaatggaaaaagtatggta

SEQ ID NO: 47333 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaggtctttgcctcaaaac

SEQ ID NO: 47334 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctttgcctcaaaaccagct

SEQ ID NO: 47335 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttattgatatatgtgtcc

SEQ ID NO: 47336 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccaagttctgtatcatcacc

SEQ ID NO: 47337 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caagttctgtatcatcacct

SEQ ID NO: 47338 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgtatcatcacctaggttc

SEQ ID NO: 47339 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taggttcaagtgaaattttg

SEQ ID NO: 47340 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aggttcaagtgaaattttga

SEQ ID NO: 47341 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcaagtgaaattttgaagg

SEQ ID NO: 47342 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcaagtgaaattttgaaggc

SEQ ID NO: 47343 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caagtgaaattttgaaggca

SEQ ID NO: 47344 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctttttttactgtgtatat

SEQ ID NO: 47345 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctttttttactgtgtatatc

SEQ ID NO: 47346 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttttttactgtgtatatcag

SEQ ID NO: 47347 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtatatcaggagaatcttg

SEQ ID NO: 47348 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaatcttgtagatttttaac

SEQ ID NO: 47349 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tagatttttaactagatttt

SEQ ID NO: 47350 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttaactagatttttagtt

SEQ ID NO: 47351 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actagatttttagtttagaa

SEQ ID NO: 47352 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagtttagaaaagtgatttg

SEQ ID NO: 47353 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agtttagaaaagtgatttgt

SEQ ID NO: 47354 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtttagaaaagtgatttgtg

SEQ ID NO: 47355 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgatttgtggggttgtgtga

SEQ ID NO: 47356 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tggggttgtgtgatggaaaa

SEQ ID NO: 47357 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggggttgtgtgatggaaaac

SEQ ID NO: 47358 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gggttgtgtgatggaaaaca

SEQ ID NO: 47359 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgtgtgatggaaaacaggg

SEQ ID NO: 47360 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atggaaaacagggaagacct

SEQ ID NO: 47361 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggaaaacagggaagaccta

SEQ ID NO: 47362 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagggaagacctaaggaaaa

SEQ ID NO: 47363 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggaagacctaaggaaaacag

SEQ ID NO: 47364 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cctaaggaaaacagaagcaa

SEQ ID NO: 47365 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acagaagcaatggttcatct

SEQ ID NO: 47366 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cagaagcaatggttcatctt

SEQ ID NO: 47367 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agaagcaatggttcatcttg

SEQ ID NO: 47368 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttcatcttggggatttgtg

SEQ ID NO: 47369 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggggatttgtgcagaattat

SEQ ID NO: 47370 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gatttgtgcagaattataag

SEQ ID NO: 47371 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atttgtgcagaattataagc

SEQ ID NO: 47372 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttgtgcagaattataagca

SEQ ID NO: 47373 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtgcagaattataagcagg

SEQ ID NO: 47374 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtgcagaattataagcaggg

SEQ ID NO: 47375 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aattataagcagggaggcct

SEQ ID NO: 47376 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttataagcagggaggcctga

SEQ ID NO: 47377 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcagggaggcctgagagatg

SEQ ID NO: 47378 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagggaggcctgagagatga

SEQ ID NO: 47379 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggcctgagagatgaaggttt

SEQ ID NO: 47380 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagatgaaggtttcagtgaa

SEQ ID NO: 47381 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gatgaaggtttcagtgaaaa

SEQ ID NO: 47382 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaggtttcagtgaaaagaga

SEQ ID NO: 47383 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aggtttcagtgaaaagagaa

SEQ ID NO: 47384 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggtttcagtgaaaagagaaa

SEQ ID NO: 47385 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcagtgaaaagagaaaggga

SEQ ID NO: 47386 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtgaaaagagaaagggaaa

SEQ ID NO: 47387 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaagagaacttccacataaa

SEQ ID NO: 47388 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttccacataaacagaattaa

SEQ ID NO: 47389 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taaacagaattaacagacta

SEQ ID NO: 47390 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagactatggcactacatat

SEQ ID NO: 47391 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
actatggcactacatattag

SEQ ID NO: 47392 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctacatattagtagttgatg

SEQ ID NO: 47393 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atattagtagttgatgtggt

SEQ ID NO: 47394 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tattagtagttgatgtggtt

SEQ ID NO: 47395 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
attagtagttgatgtggttg

SEQ ID NO: 47396 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttagtagttgatgtggttgg

SEQ ID NO: 47397 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtagttgatgtggttggggg

SEQ ID NO: 47398 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agttgatgtggttgggggtg

SEQ ID NO: 47399 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gttgatgtggttgggggtgg

SEQ ID NO: 47400 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttgggggtggaggatatca

SEQ ID NO: 47401 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgggggtggaggatatcaa

SEQ ID NO: 47402 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggatatcaaaggcttctcca

SEQ ID NO: 47403 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggcttctccaaagttccaaa

SEQ ID NO: 47404 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcttctccaaagttccaaat

SEQ ID NO: 47405 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctccaaagttccaaatgggt

SEQ ID NO: 47406 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tactattacctatactgttt

SEQ ID NO: 47407 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attacctatactgtttaaga

SEQ ID NO: 47408 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acctatactgtttaagaaag

SEQ ID NO: 47409 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctatactgtttaagaaagaa

SEQ ID NO: 47410 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtttaagaaagaagagaaac

SEQ ID NO: 47411 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaagaagagaaactagtct

SEQ ID NO: 47412 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagagaaactagtctaagat

SEQ ID NO: 47413 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agattagtttttaaccaatg

SEQ ID NO: 47414 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caatgaagcattacaaaaca

SEQ ID NO: 47415 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagactaaatacaaatataa

SEQ ID NO: 47416 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caaatataaaagttattcta

SEQ ID NO: 47417 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagttattctatagtgtgaa

SEQ ID NO: 47418 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggtctctttatttctacaa

SEQ ID NO: 47419 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttatttctacaatggttct

SEQ ID NO: 47420 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttatttctacaatggttctc

SEQ ID NO: 47421 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aacattttgcttctgaaaat

SEQ ID NO: 47422 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcttctgaaaattagtttat

SEQ ID NO: 47423 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttctgaaaattagtttatta

SEQ ID NO: 47424 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attgacaattctgaaactat

SEQ ID NO: 47425 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgacaattctgaaactata

SEQ ID NO: 47426 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caaaaatgattgaacccaaa

SEQ ID NO: 47427 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacatctttccataaatgcc

SEQ ID NO: 47428 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccataaatgcctagcgatac

SEQ ID NO: 47429 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cataaatgcctagcgatact

SEQ ID NO: 47430 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atcactcactatcctctccc

SEQ ID NO: 47431 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagttctcttaccctaaaat

SEQ ID NO: 47432 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaaataagacatttttctc

SEQ ID NO: 47433 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ttttctctagcattctgcct

SEQ ID NO: 47434 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttctctagcattctgcctc

SEQ ID NO: 47435 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgcctcgggtgatacacatt

SEQ ID NO: 47436 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtgatacacatttagcaatt

SEQ ID NO: 47437 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgatacacatttagcaattt

SEQ ID NO: 47438 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tacacatttagcaatttggg

SEQ ID NO: 47439 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caatttgggtggtacctgat

SEQ ID NO: 47440 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aatttgggtggtacctgatt

SEQ ID NO: 47441 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atttgggtggtacctgattg

SEQ ID NO: 47442 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttgggtggtacctgattgg

SEQ ID NO: 47443 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gggtggtacctgattggggg

SEQ ID NO: 47444 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cgcctatgcccttcgacacc

SEQ ID NO: 47445 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcctatgcccttcgacacca

SEQ ID NO: 47446 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatgcccttcgacaccaagg

SEQ ID NO: 47447 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttctgatttcgacaatttct

SEQ ID NO: 47448 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atctcccttttcctctccac

SEQ ID NO: 47449 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctcccttttcctctccactg

SEQ ID NO: 47450 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cccttttcctctccactgga

SEQ ID NO: 47451 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcttctgtttcttctttctt

SEQ ID NO: 47452 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcttctttctttagcacttt

SEQ ID NO: 47453 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttctttctttagcactttta

SEQ ID NO: 47454 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctttagcacttttagagct

SEQ ID NO: 47455 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agcacttttagagctcagtt

SEQ ID NO: 47456 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agagctcagtttggatgttt

SEQ ID NO: 47457 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gctcagtttggatgtttcag

SEQ ID NO: 47458 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgtttcagaagaactctct

SEQ ID NO: 47459 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtttcagaagaactctctga

SEQ ID NO: 47460 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttcagaagaactctctgag

SEQ ID NO: 47461 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctcctaatacttgtatatt

SEQ ID NO: 47462 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccgctgccgctgcaattgcc

SEQ ID NO: 47463 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgccgctgcaattgcctggt

SEQ ID NO: 47464 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gccgctgcaattgcctggtt

SEQ ID NO: 47465 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcaattgcctggttgggcc

SEQ ID NO: 47466 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caagacgttaacacttaaat

SEQ ID NO: 47467 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatgagtcatttccaaatcc

SEQ ID NO: 47468 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgagtcatttccaaatcct

SEQ ID NO: 47469 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttccaaatcctaggaaaccc

SEQ ID NO: 47470 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tccaaatcctaggaaaccct

SEQ ID NO: 47471 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatcctaggaaaccctagga

SEQ ID NO: 47472 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atcctaggaaaccctaggac

SEQ ID NO: 47473 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acaggacatctttcacctat

SEQ ID NO: 47474 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cacctattagcataacaaca

SEQ ID NO: 47475 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cgttttctttacacaatgat

SEQ ID NO: 47476 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caatgatcagaatgcttaca

SEQ ID NO: 47477 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgcttacaaagtatatatt

SEQ ID NO: 47478 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatatatttggtttttgtct

SEQ ID NO: 47479 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atatatttggtttttgtctc

SEQ ID NO: 47480 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttgtctcaggttgaaata

SEQ ID NO: 47481 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aataaagctctattgtattt

SEQ ID NO: 47482 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acatgttattaatttgctta

SEQ ID NO: 47483 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttattaatttgcttacagta

SEQ ID NO: 47484 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaattaaatattatatgtta

SEQ ID NO: 47485 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attatatgttaaagttttac

SEQ ID NO: 47486 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttatatgttaaagttttaca

SEQ ID NO: 47487 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaagttttacaaggtaattt

SEQ ID NO: 47488 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actcgcataaaccatgcaat

SEQ ID NO: 47489 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcataaaccatgcaataaga

SEQ ID NO: 47490 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagacagacaatttgattat

SEQ ID NO: 47491 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agacagacaatttgattatc

SEQ ID NO: 47492 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aattaactccatatcatcaa

SEQ ID NO: 47493 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctccatatcatcaatagaat

SEQ ID NO: 47494 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tccatatcatcaatagaatc

SEQ ID NO: 47495 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caatagaatcaggcactcta

SEQ ID NO: 47496 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggcactctatggtttaata

SEQ ID NO: 47497 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctatggtttaataaagatt

SEQ ID NO: 47498 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaaaataaatgaattatta

SEQ ID NO: 47499 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttattaaagcataatattgt

SEQ ID NO: 47500 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaagcataatattgtaaga

SEQ ID NO: 47501 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agcataatattgtaagaaag

SEQ ID NO: 47502 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taatattgtaagaaagtggt

SEQ ID NO: 47503 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatattgtaagaaagtggta

SEQ ID NO: 47504 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtggtaaggtcaatgactat

SEQ ID NO: 47505 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attggcctaaatgaaacttc

SEQ ID NO: 47506 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttggcctaaatgaaacttct

SEQ ID NO: 47507 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgaaacttctgggaattccc

SEQ ID NO: 47508 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaacttctgggaattccct

SEQ ID NO: 47509 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acttctgggaattccctagg

SEQ ID NO: 47510 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggaattccctaggtagtacc

SEQ ID NO: 47511 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaattccctaggtagtacct

SEQ ID NO: 47512 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aggtagtacctgggataacc

SEQ ID NO: 47513 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaaaattcttgtaaaaaca

SEQ ID NO: 47514 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaaattcttgtaaaaacat

SEQ ID NO: 47515 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgtaaaaacatgggaaata

SEQ ID NO: 47516 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ataaagatataaatgaaaaa

SEQ ID NO: 47517 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataaatgaaaaacagaaaaa

SEQ ID NO: 47518 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaaaagtcatcttacctcc

SEQ ID NO: 47519 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcttacctcccagaaataat

SEQ ID NO: 47520 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtatgtataattttaaaatt

SEQ ID NO: 47521 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ttttaaaattgagattgtat

SEQ ID NO: 47522 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaatccatcattattctaa

SEQ ID NO: 47523 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aataattttaaaaaaacaca

SEQ ID NO: 47524 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taaaaaaacacatagttcta

SEQ ID NO: 47525 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctatggcaaaataatacttt

SEQ ID NO: 47526 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacaattttcataattttct

SEQ ID NO: 47527 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgcactgaatatttgtgcat

SEQ ID NO: 47528 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atcagaatttatctgcattg

SEQ ID NO: 47529 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attgccctcccctaatacat

SEQ ID NO: 47530 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctaatacattagactccttg

SEQ ID NO: 47531 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatacattagactccttgaa

SEQ ID NO: 47532 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
actccttgaagagatttaac

SEQ ID NO: 47533 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctccttgaagagatttaact

SEQ ID NO: 47534 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atttaactaggtgaaacctt

SEQ ID NO: 47535 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaaccttcagacaaatgtt

SEQ ID NO: 47536 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaccttcagacaaatgtta

SEQ ID NO: 47537 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gacaaatgttaaggcaactg

SEQ ID NO: 47538 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atttgaaattatgtttctct

SEQ ID NO: 47539 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattatgtttctcttagtac

SEQ ID NO: 47540 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttctcaaacatttacactg

SEQ ID NO: 47541 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttacactgaagaatctctc

SEQ ID NO: 47542 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cactgaagaatctctctgga

SEQ ID NO: 47543 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgaagaatctctctggaaa

SEQ ID NO: 47544 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgaagaatctctctggaaag

SEQ ID NO: 47545 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atctctctggaaagaggatt

SEQ ID NO: 47546 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctctctggaaagaggatta

SEQ ID NO: 47547 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctctggaaagaggattaag

SEQ ID NO: 47548 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctctggaaagaggattaagg

SEQ ID NO: 47549 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggattaaggaggaaactttc

SEQ ID NO: 47550 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaatctatgacaacctaaat

SEQ ID NO: 47551 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caaaacatgatgcactgttt

SEQ ID NO: 47552 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
actgttttagtcatacccca

SEQ ID NO: 47553 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttttagtcataccccatag

SEQ ID NO: 47554 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttagtcataccccatagaa

SEQ ID NO: 47555 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgaaaccactgtatacaat

SEQ ID NO: 47556 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
actgtatacaattggtactc

SEQ ID NO: 47557 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctgtatacaattggtactct

SEQ ID NO: 47558 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgtatacaattggtactctg

SEQ ID NO: 47559 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attgtatatatatataaatt

SEQ ID NO: 47560 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatttaatcaattattctaa

SEQ ID NO: 47561 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taataatttaaaaaaacaca

SEQ ID NO: 47562 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtatatgtgtatgtatata

SEQ ID NO: 47563 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gacatacacacacacacact

SEQ ID NO: 47564 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acacacacactaagtcattg

SEQ ID NO: 47565 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cacacacactaagtcattgt

SEQ ID NO: 47566 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cactaagtcattgtaggtaa

SEQ ID NO: 47567 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actaagtcattgtaggtaaa

SEQ ID NO: 47568 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcattgtaggtaaaaggttt

SEQ ID NO: 47569 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attgtaggtaaaaggtttaa

SEQ ID NO: 47570 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgtaggtaaaaggtttaag

SEQ ID NO: 47571 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggtaaaaggtttaagaggaa

SEQ ID NO: 47572 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aggtttaagaggaacagcct

SEQ ID NO: 47573 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gccttagatcacttttcatg

SEQ ID NO: 47574 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tagatcacttttcatgcagt

SEQ ID NO: 47575 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcatgcagtgagatgatta

SEQ ID NO: 47576 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcatgcagtgagatgattat

SEQ ID NO: 47577 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
catgcagtgagatgattatg

SEQ ID NO: 47578 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagtgagatgattatgggga

SEQ ID NO: 47579 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatggggaaagtatcaattc

SEQ ID NO: 47580 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggaaagtatcaattctagct

SEQ ID NO: 47581 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtatcaattctagctcagcc

SEQ ID NO: 47582 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attctagctcagcccagaat

SEQ ID NO: 47583 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attggttcctttttccacac

SEQ ID NO: 47584 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cctttttccacaccagaaat

SEQ ID NO: 47585 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctttttccacaccagaaatg

SEQ ID NO: 47586 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccacaccagaaatgaggata

SEQ ID NO: 47587 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatacacaaaaattcatta

SEQ ID NO: 47588 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaattcattaaagaaaatc

SEQ ID NO: 47589 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcattaaagaaaatctagc

SEQ ID NO: 47590 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cattaaagaaaatctagctg

SEQ ID NO: 47591 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaagaaaatctagctggag

SEQ ID NO: 47592 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaagaaaatctagctggaga

SEQ ID NO: 47593 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatctagctggagaaggcc

SEQ ID NO: 47594 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaaggccaagcatataccg

SEQ ID NO: 47595 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaggccaagcatataccgca

SEQ ID NO: 47596 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
accgtttgcatttctacctc

SEQ ID NO: 47597 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccgtttgcatttctacctct

SEQ ID NO: 47598 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttgcatttctacctctagg

SEQ ID NO: 47599 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagaattttaaatcaaataa

SEQ ID NO: 47600 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaatcaaataacagtacct

SEQ ID NO: 47601 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcttcttcttgctctttttt

SEQ ID NO: 47602 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
cttcttgctcttttttaaga

SEQ ID NO: 47603 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaattctaattctttctgtt

SEQ ID NO: 47604 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagcttcttcaatgtttgcc

SEQ ID NO: 47605 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gttctgttcttcatatgcca

SEQ ID NO: 47606 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcatatgccatggcaacca

SEQ ID NO: 47607 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatgccatggcaaccacagc

SEQ ID NO: 47608 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgccatggcaaccacagcc

SEQ ID NO: 47609 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggcaaccacagccaggatc

SEQ ID NO: 47610 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acagccaggatcaagtttat

SEQ ID NO: 47611 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggatcaagtttattagataa

SEQ ID NO: 47612 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gatcaagtttattagataaa

SEQ ID NO: 47613 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcaagtttattagataaaag

SEQ ID NO: 47614 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttattagataaaaggagcc

SEQ ID NO: 47615 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttattagataaaaggagccc

SEQ ID NO: 47616 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccaggaaaatcactacgaca

SEQ ID NO: 47617 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggaaaatcactacgacaaag

SEQ ID NO: 47618 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctacgacaaagaagatcatg

SEQ ID NO: 47619 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tacgacaaagaagatcatgt

SEQ ID NO: 47620 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaagatcatgtaggttttgc

SEQ ID NO: 47621 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gatcatgtaggttttgccag

SEQ ID NO: 47622 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taggttttgccagcagcacg

SEQ ID NO: 47623 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgccagcagcacgcagcgtc

SEQ ID NO: 47624 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gccagcagcacgcagcgtct

SEQ ID NO: 47625 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ccagcagcacgcagcgtcta

SEQ ID NO: 47626 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acgcagcgtctagggaaaaa

SEQ ID NO: 47627 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attgtcatttgaacaataaa

SEQ ID NO: 47628 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgaacaataaaaagtttttt

SEQ ID NO: 47629 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtaaattatttcaatttga

SEQ ID NO: 47630 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtaaattatttcaatttgac

SEQ ID NO: 47631 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatttcaatttgacaggcat

SEQ ID NO: 47632 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acaggcatgagcaaatctga

SEQ ID NO: 47633 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catgagcaaatctgacagtt

SEQ ID NO: 47634 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctcatgttatcaaaaatata

SEQ ID NO: 47635 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
catgttatcaaaaatataaa

SEQ ID NO: 47636 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatcaaaaatataaagagaa

SEQ ID NO: 47637 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agagaaaagttatatcttca

SEQ ID NO: 47638 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acaaatattaaacacatttt

SEQ ID NO: 47639 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaaacacattttcagtacg

SEQ ID NO: 47640 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cattttcagtacgaagaata

SEQ ID NO: 47641 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgtaatatgcttgtacta

SEQ ID NO: 47642 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcttgtactaaagtcatgt

SEQ ID NO: 47643 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgtaagattcttgattatt

SEQ ID NO: 47644 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agattcttgattattaagtg

SEQ ID NO: 47645 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttcttgattattaagtgtag

SEQ ID NO: 47646 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaatcatgcattttttccta

SEQ ID NO: 47647 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctttgctcactttcaaattt

SEQ ID NO: 47648 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttgctcactttcaaatttt

SEQ ID NO: 47649 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcactttcaaattttaggaa

SEQ ID NO: 47650 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cactttcaaattttaggaac

SEQ ID NO: 47651 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttaggaacaggtgatatcca

SEQ ID NO: 47652 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atatcattgaatgttaacac

SEQ ID NO: 47653 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatcattgaatgttaacact

SEQ ID NO: 47654 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cattgaatgttaacactagg

SEQ ID NO: 47655 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaatgttaacactaggcaga

SEQ ID NO: 47656 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taattactttattcatctca

SEQ ID NO: 47657 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aattactttattcatctcat

SEQ ID NO: 47658 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gctttctttgctttttaaaa

SEQ ID NO: 47659 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatagaattttttttcaaaa

SEQ ID NO: 47660 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attttttttcaaaatagttt

SEQ ID NO: 47661 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttttttttcaaaatagtttt

SEQ ID NO: 47662 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttcaaaatagttttaggat

SEQ ID NO: 47663 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcaaaatagttttaggatta

SEQ ID NO: 47664 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caaaatagttttaggattag

SEQ ID NO: 47665 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attagaggaaaattaaactg

SEQ ID NO: 47666 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttagaggaaaattaaactga

SEQ ID NO: 47667 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggaaaattaaactgaaggta

SEQ ID NO: 47668 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaattaaactgaaggtaca

SEQ ID NO: 47669 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttttctttttttcttttttt

SEQ ID NO: 47670 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttttttttggcataacgtg

SEQ ID NO: 47671 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttttttttggcataacgtgc

SEQ ID NO: 47672 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taacgtgcaggtttgttaca

SEQ ID NO: 47673 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aacgtgcaggtttgttacat

SEQ ID NO: 47674 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtgcaggtttgttacatggg

SEQ ID NO: 47675 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acatgggtagacacgtgcca

SEQ ID NO: 47676 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgggtagacacgtgccatgg

SEQ ID NO: 47677 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catcaacctgttacctacat

SEQ ID NO: 47678 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atcaacctgttacctacatt

SEQ ID NO: 47679 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cctttgccccccaccaccga

SEQ ID NO: 47680 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctttgccccccaccaccgac

SEQ ID NO: 47681 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cccccaccaccgacaggccc

SEQ ID NO: 47682 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attgcccacctctcactcat

SEQ ID NO: 47683 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cccacctctcactcatgagt

SEQ ID NO: 47684 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gagtgagaacatgcgttgtt

SEQ ID NO: 47685 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttggttttctgttcctgttt

SEQ ID NO: 47686 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgttcctgttttagtttgct

SEQ ID NO: 47687 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttttagtttgctgagaatga

SEQ ID NO: 47688 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgctgagaatgatggtttc

SEQ ID NO: 47689 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcttcatccatgtccctgca

SEQ ID NO: 47690 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttcatccatgtccctgcaa

SEQ ID NO: 47691 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catgaacttattctttttta

SEQ ID NO: 47692 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tattcttttttatggctgca

SEQ ID NO: 47693 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatggctgcatagtattcca

SEQ ID NO: 47694 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtgccacattttctttatc

SEQ ID NO: 47695 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttatccagtctatcattga

SEQ ID NO: 47696 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttatccagtctatcattgat

SEQ ID NO: 47697 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtctatcattgatgggcatt

SEQ ID NO: 47698 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tctatcattgatgggcattt

SEQ ID NO: 47699 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcattgatgggcatttgggt

SEQ ID NO: 47700 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgggcatttgggttggttcc

SEQ ID NO: 47701 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccagtctttgctattgtgaa

SEQ ID NO: 47702 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtgtgcatgtgtctttacca

SEQ ID NO: 47703 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagaatgatatgtaatcttt

SEQ ID NO: 47704 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agaatgatatgtaatctttt

SEQ ID NO: 47705 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taatcttttgggtatatacc

SEQ ID NO: 47706 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttgggtatatacccagtaa

SEQ ID NO: 47707 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttgggtatatacccagtaat

SEQ ID NO: 47708 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atacccagtaatgggattgc

SEQ ID NO: 47709 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tacccagtaatgggattgct

SEQ ID NO: 47710 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgggtcactgtcttccacac

SEQ ID NO: 47711 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctaatttacactcctaccaa

SEQ ID NO: 47712 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cactcctaccaacagtttaa

SEQ ID NO: 47713 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctatttctccacattttctc

SEQ ID NO: 47714 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttaattatcaccattctaac

SEQ ID NO: 47715 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atcaccattctaactggcat

SEQ ID NO: 47716 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccattctaactggcatgaga

SEQ ID NO: 47717 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catgagatggtatctcattg

SEQ ID NO: 47718 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttgaattgcatttctctaa

SEQ ID NO: 47719 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aattgcatttctctaatggc

SEQ ID NO: 47720 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctctaatggccagtgatgat

SEQ ID NO: 47721 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagctttttttcatatgttt

SEQ ID NO: 47722 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttttcatatgtttaagtta

SEQ ID NO: 47723 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttttcatatgtttaagttat

SEQ ID NO: 47724 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taagttatgggatacatgtg

SEQ ID NO: 47725 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggatacatgtgaagaacatg

SEQ ID NO: 47726 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gatacatgtgaagaacatgc

SEQ ID NO: 47727 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catgtgaagaacatgcaggt

SEQ ID NO: 47728 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaacatgcaggttggttaca

SEQ ID NO: 47729 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aacatgcaggttggttacac

SEQ ID NO: 47730 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acacaggtatacatgtgcta

SEQ ID NO: 47731 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caggtatacatgtgctatgg

SEQ ID NO: 47732 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccacctatcaacccattatc

SEQ ID NO: 47733 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cacctatcaacccattatct

SEQ ID NO: 47734 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caacccattatctaggtttt

SEQ ID NO: 47735 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttttaagacctgcatgcat

SEQ ID NO: 47736 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttttaagacctgcatgcatt

SEQ ID NO: 47737 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taagacctgcatgcattagg

SEQ ID NO: 47738 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccttgcctcccaccccccaa

SEQ ID NO: 47739 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttgcctcccaccccccaac

SEQ ID NO: 47740 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tcccaccccccaacaggccc

SEQ ID NO: 47741 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attgttcaactcccacttat

SEQ ID NO: 47742 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttcaactcccacttatgagt

SEQ ID NO: 47743 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cacttatgagtgagaacatg

SEQ ID NO: 47744 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gagtgagaacatgcagtgtt

SEQ ID NO: 47745 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttggttttctcttcctgtat

SEQ ID NO: 47746 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcttcctgtattagtttgct

SEQ ID NO: 47747 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttcctgtattagtttgctg

SEQ ID NO: 47748 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tattagtttgctgaggatga

SEQ ID NO: 47749 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgctgaggatgatggcttc

SEQ ID NO: 47750 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcttcatccatgtccctgta

SEQ ID NO: 47751 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttcatccatgtccctgtaa

SEQ ID NO: 47752 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgatctcattcttttttaa

SEQ ID NO: 47753 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attcttttttaatggctgca

SEQ ID NO: 47754 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatggctgcatagtattcca

SEQ ID NO: 47755 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttatacaatttaacattga

SEQ ID NO: 47756 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttatacaatttaacattgat

SEQ ID NO: 47757 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttaacattgatgggcattt

SEQ ID NO: 47758 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catctctttgctattgtaaa

SEQ ID NO: 47759 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatgtgtgcatgtgtctttg

SEQ ID NO: 47760 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtgtgcatgtgtctttgtag

SEQ ID NO: 47761 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
agaatgatttatattcgttt

SEQ ID NO: 47762 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tattcgtttcggtatatacc

SEQ ID NO: 47763 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttcggtatatacccagtaa

SEQ ID NO: 47764 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttcggtatatacccagtaat

SEQ ID NO: 47765 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atacccagtaatgggattgc

SEQ ID NO: 47766 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tacccagtaatgggattgct

SEQ ID NO: 47767 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatgggattgctaggtcaaa

SEQ ID NO: 47768 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gctaggtcaaatggtatttc

SEQ ID NO: 47769 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcaaatggtatttctggttc

SEQ ID NO: 47770 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caaatggtatttctggttct

SEQ ID NO: 47771 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atttctggttctaggtcctt

SEQ ID NO: 47772 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttctggttctaggtcctta

SEQ ID NO: 47773 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctaatttacactcccaccaa

SEQ ID NO: 47774 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cactcccaccaacagtgtaa

SEQ ID NO: 47775 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaagtgctactatttcttca

SEQ ID NO: 47776 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctatttcttcatagcctcac

SEQ ID NO: 47777 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atcaccattctgactgactt

SEQ ID NO: 47778 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccattctgactgacttgaga

SEQ ID NO: 47779 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cttgagatggtatctcattg

SEQ ID NO: 47780 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcttaatgatcactgatgtt

SEQ ID NO: 47781 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gagctttttttcatgttttt

SEQ ID NO: 47782 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccgcataaatgtcttctttt

SEQ ID NO: 47783 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cataaatgtcttcttttgag

SEQ ID NO: 47784 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atcctttgcccactttttga

SEQ ID NO: 47785 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcctttgcccactttttgat

SEQ ID NO: 47786 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cccactttttgatgggatgc

SEQ ID NO: 47787 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccactttttgatgggatgca

SEQ ID NO: 47788 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttttgatgggatgcaaggc

SEQ ID NO: 47789 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatgtaatccatcacataaa

SEQ ID NO: 47790 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaccacatgattatctcaa

SEQ ID NO: 47791 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catgattatctcaatagatg

SEQ ID NO: 47792 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgattatctcaatagatgca

SEQ ID NO: 47793 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatctcaatagatgcagag

SEQ ID NO: 47794 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatctcaatagatgcagaga

SEQ ID NO: 47795 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttaaaaactatcaataaac

SEQ ID NO: 47796 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttaaaaactatcaataaact

SEQ ID NO: 47797 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atcaataaactaggtattga

SEQ ID NO: 47798 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggaacatatctcaaaataat

SEQ ID NO: 47799 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aacatatctcaaaataataa

SEQ ID NO: 47800 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agctatttatgaaaactcca

SEQ ID NO: 47801 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atagccaatatcatactgaa

SEQ ID NO: 47802 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tagccaatatcatactgaat

SEQ ID NO: 47803 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatcatactgaatgggaaa

SEQ ID NO: 47804 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catactgaatgggaaaaagc

SEQ ID NO: 47805 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actgaatgggaaaaagctgg

SEQ ID NO: 47806 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaagcattccctttaaaaac

SEQ ID NO: 47807 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttccctttaaaaactggcac

SEQ ID NO: 47808 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttaaaaactggcacaagac

SEQ ID NO: 47809 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttaaaaactggcacaagaca

SEQ ID NO: 47810 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctcaccactgctattcaata

SEQ ID NO: 47811 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
actgctattcaatatagtgt

SEQ ID NO: 47812 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caatatagtgttggaatttc

SEQ ID NO: 47813 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atagtgttggaatttctggc

SEQ ID NO: 47814 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tagtgttggaatttctggcc

SEQ ID NO: 47815 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agtgttggaatttctggcca

SEQ ID NO: 47816 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaatttctggccagggcaat

SEQ ID NO: 47817 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctggccagggcaatcagac

SEQ ID NO: 47818 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggccagggcaatcagacaa

SEQ ID NO: 47819 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagggcaatcagacaagaga

SEQ ID NO: 47820 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcagacaagagaaagaaata

SEQ ID NO: 47821 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagacaagagaaagaaataa

SEQ ID NO: 47822 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agacaagagaaagaaataaa

SEQ ID NO: 47823 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agaaataaagggtattcaaa

SEQ ID NO: 47824 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaataaagggtattcaaat

SEQ ID NO: 47825 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataaagggtattcaaatagg

SEQ ID NO: 47826 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gggtattcaaataggaagac

SEQ ID NO: 47827 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tattcaaataggaagaccgg

SEQ ID NO: 47828 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatgacatgattctatatt

SEQ ID NO: 47829 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttagaaaacccgatcatct

SEQ ID NO: 47830 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccaaaactctttaaactgat

SEQ ID NO: 47831 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttaaactgataagcaactt

SEQ ID NO: 47832 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aactgataagcaacttcagc

SEQ ID NO: 47833 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actgataagcaacttcagca

SEQ ID NO: 47834 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagcaacttcagcaaggtat

SEQ ID NO: 47835 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agcaacttcagcaaggtatc

SEQ ID NO: 47836 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaatcaatgtgcaaaaatca

SEQ ID NO: 47837 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatcaatgtgcaaaaatcac

SEQ ID NO: 47838 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcattcctatacaccaacaa

SEQ ID NO: 47839 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cctatacaccaacaatagac

SEQ ID NO: 47840 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atacaccaacaatagacaag

SEQ ID NO: 47841 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acaccaacaatagacaagca

SEQ ID NO: 47842 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
accaacaatagacaagcaga

SEQ ID NO: 47843 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcccatttgcaattgctata

SEQ ID NO: 47844 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccatttgcaattgctataaa

SEQ ID NO: 47845 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tataaagagaataaaatacc

SEQ ID NO: 47846 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ataaagagaataaaatacct

SEQ ID NO: 47847 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaataaaatacctaggaata

SEQ ID NO: 47848 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acctaggaatacagcttaca

SEQ ID NO: 47849 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cctaggaatacagcttacaa

SEQ ID NO: 47850 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acagcttacaaaggatatga

SEQ ID NO: 47851 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggatatgaaagacctcttc

SEQ ID NO: 47852 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagacctcttcaagaactac

SEQ ID NO: 47853 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaactacaagccactactc

SEQ ID NO: 47854 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaactacaagccactactca

SEQ ID NO: 47855 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagccactactcaaggaaac

SEQ ID NO: 47856 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gccactactcaaggaaacaa

SEQ ID NO: 47857 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cactactcaaggaaacaaga

SEQ ID NO: 47858 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actactcaaggaaacaagag

SEQ ID NO: 47859 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caagagaggacacaaacaaa

SEQ ID NO: 47860 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggaaaaacattccatactca

SEQ ID NO: 47861 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaacattccatactcatgga

SEQ ID NO: 47862 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aacattccatactcatggat

SEQ ID NO: 47863 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attccatactcatggatagg

SEQ ID NO: 47864 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagaatcaatgtcatgtaaa

SEQ ID NO: 47865 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtaaatggccatactgccga

SEQ ID NO: 47866 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atactgccgaaagtaattta

SEQ ID NO: 47867 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtaatttatagattcaatgc

SEQ ID NO: 47868 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aattaccattgacatcttca

SEQ ID NO: 47869 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cattgacatcttcacagaat

SEQ ID NO: 47870 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctttaaatttcatatgaaac

SEQ ID NO: 47871 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttaaatttcatatgaaacc

SEQ ID NO: 47872 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatttcatatgaaaccagga

SEQ ID NO: 47873 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttcatatgaaaccaggaaa

SEQ ID NO: 47874 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaccaggaaagagcacata

SEQ ID NO: 47875 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggaaagagcacatatagca

SEQ ID NO: 47876 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catatagcaaagacaattct

SEQ ID NO: 47877 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaagacaattctaagcaaa

SEQ ID NO: 47878 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattctaagcaaaaagaaca

SEQ ID NO: 47879 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctaagcaaaaagaacaaagc

SEQ ID NO: 47880 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagcaaaaagaacaaagctg

SEQ ID NO: 47881 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agcaaaaagaacaaagctgg

SEQ ID NO: 47882 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagaacaaagctggaggcat

SEQ ID NO: 47883 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgacttcaaactatactat

SEQ ID NO: 47884 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgacttcaaactatactatg

SEQ ID NO: 47885 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caaactatactatgaggtta

SEQ ID NO: 47886 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgaggttacagtaaccaaaa

SEQ ID NO: 47887 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttacagtaaccaaaacagca

SEQ ID NO: 47888 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagtaaccaaaacagcatgg

SEQ ID NO: 47889 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taaccaaaacagcatggtag

SEQ ID NO: 47890 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcatggtagtggtacccaaa

SEQ ID NO: 47891 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtggtacccaaacagacata

SEQ ID NO: 47892 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggtacccaaacagacatat

SEQ ID NO: 47893 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caaacagacatataggccaa

SEQ ID NO: 47894 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agacatataggccaatggaa

SEQ ID NO: 47895 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tataggccaatggaatagaa

SEQ ID NO: 47896 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taggccaatggaatagaata

SEQ ID NO: 47897 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atggaatagaatagagacct

SEQ ID NO: 47898 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaataacaccacacttctac

SEQ ID NO: 47899 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcgacaaacctgacaaaaac

SEQ ID NO: 47900 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cctgacaaaaacaagcaatg

SEQ ID NO: 47901 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acaaaaacaagcaatgtgga

SEQ ID NO: 47902 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caaaaacaagcaatgtggaa

SEQ ID NO: 47903 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aggattccctatataataaa

SEQ ID NO: 47904 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccctatataataaatggtgc

SEQ ID NO: 47905 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctatataataaatggtgct

SEQ ID NO: 47906 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctatataataaatggtgctg

SEQ ID NO: 47907 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tataataaatggtgctgggg

SEQ ID NO: 47908 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ataaatggtgctggggaagc

SEQ ID NO: 47909 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atggtgctggggaagctggc

SEQ ID NO: 47910 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggaagctggctagccatatg

SEQ ID NO: 47911 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catatgcagaaaactgaaac

SEQ ID NO: 47912 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atatgcagaaaactgaaact

SEQ ID NO: 47913 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccttatacaaaaattaactc

SEQ ID NO: 47914 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atacaaaaattaactcaaga

SEQ ID NO: 47915 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattaactcaagatggatta

SEQ ID NO: 47916 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
accccaaaccatgaaaaccc

SEQ ID NO: 47917 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccaaaccatgaaaaccctag

SEQ ID NO: 47918 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaaaaccctagaagaaaacc

SEQ ID NO: 47919 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaaccctagaagaaaacct

SEQ ID NO: 47920 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaacctaggcaacaccatt

SEQ ID NO: 47921 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaacctaggcaacaccattc

SEQ ID NO: 47922 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aggcaacaccattcaggaaa

SEQ ID NO: 47923 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggcaacaccattcaggaaat

SEQ ID NO: 47924 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caccattcaggaaataggca

SEQ ID NO: 47925 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
accattcaggaaataggcat

SEQ ID NO: 47926 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcaggaaataggcatgggca

SEQ ID NO: 47927 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttcatgacaaaaataccaa

SEQ ID NO: 47928 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
accaaaagcaattgcaacca

SEQ ID NO: 47929 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccaaagccaaaattgacaaa

SEQ ID NO: 47930 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caaagccaaaattgacaaat

SEQ ID NO: 47931 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatgggatataactaaacta

SEQ ID NO: 47932 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgggatataactaaactaaa

SEQ ID NO: 47933 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaactaaagagcttctgca

SEQ ID NO: 47934 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagagcttctgcacagcaa

SEQ ID NO: 47935 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acagcaaaagaaactaacat

SEQ ID NO: 47936 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agcaaaagaaactaacatca

SEQ ID NO: 47937 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaaactaacatcagagtgaa

SEQ ID NO: 47938 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaactaacatcagagtgaac

SEQ ID NO: 47939 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagagtgaacaggcaaacta

SEQ ID NO: 47940 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgaacaggcaaactatagaa

SEQ ID NO: 47941 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaacaggcaaactatagaat

SEQ ID NO: 47942 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acaggcaaactatagaatgg

SEQ ID NO: 47943 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatagaatgggagaaaaatt

SEQ ID NO: 47944 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggcaatctacccatctgaca

SEQ ID NO: 47945 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcaatctacccatctgacaa

SEQ ID NO: 47946 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctgacaaaggtctaatatt

SEQ ID NO: 47947 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtctaatattaagaatctac

SEQ ID NO: 47948 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agtaacttaaacaaatttat

SEQ ID NO: 47949 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taatatacttttatcataca

SEQ ID NO: 47950 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatcatacaaagcatttta

SEQ ID NO: 47951 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaagcattttaaagtgaatt

SEQ ID NO: 47952 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagcattttaaagtgaattt

SEQ ID NO: 47953 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attttaaagtgaatttagga

SEQ ID NO: 47954 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actgatattaaatgaaaaat

SEQ ID NO: 47955 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atttgtgtttctttaatttt

SEQ ID NO: 47956 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtttctttaattttgagta

SEQ ID NO: 47957 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtttctttaattttgagtaa

SEQ ID NO: 47958 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcattcccatttttgctgta

SEQ ID NO: 47959 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gaattcatttataatattct

SEQ ID NO: 47960 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttataatattctcggaaata

SEQ ID NO: 47961 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaaataaagtaaatataaaa

SEQ ID NO: 47962 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaataaagtaaatataaaat

SEQ ID NO: 47963 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatataaaataggccaaaa

SEQ ID NO: 47964 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggccaaaaaagaaaaaaaaa

SEQ ID NO: 47965 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagaaaaaaaaacagatctg

SEQ ID NO: 47966 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aacagatctgcagctattct

SEQ ID NO: 47967 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atctgcagctattctgagaa

SEQ ID NO: 47968 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatcattgttatgtgtacta

SEQ ID NO: 47969 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtactatagaataatcattt

SEQ ID NO: 47970 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cattttggtctccttccttt

SEQ ID NO: 47971 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggtctccttccttttggct

SEQ ID NO: 47972 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttccttttggcttggctgct

SEQ ID NO: 47973 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttggctgctgagactatac

SEQ ID NO: 47974 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gctgagactatacaagtaaa

SEQ ID NO: 47975 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgagactatacaagtaaatg

SEQ ID NO: 47976 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atacaagtaaatggagacca

SEQ ID NO: 47977 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaatggagaccacagcccc

SEQ ID NO: 47978 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatggagaccacagccccaa

SEQ ID NO: 47979 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atggagaccacagccccaag

SEQ ID NO: 47980 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gccccaagaggttcacattc

SEQ ID NO: 47981 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caagaggttcacattcaagt

SEQ ID NO: 47982 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaggttcacattcaagtta

SEQ ID NO: 47983 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaggttcacattcaagttag

SEQ ID NO: 47984 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cacattcaagttagaggaaa

SEQ ID NO: 47985 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaattaccacttgcaatac

SEQ ID NO: 47986 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aattaccacttgcaatacaa

SEQ ID NO: 47987 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caagagatcaatgatataaa

SEQ ID NO: 47988 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagatcaatgatataaatgg

SEQ ID NO: 47989 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaagaaaatacaaaaaatca

SEQ ID NO: 47990 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaaatacaaaaaatcatgg

SEQ ID NO: 47991 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caaaaaatcatggaagtcta

SEQ ID NO: 47992 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaatcatggaagtctacagt

SEQ ID NO: 47993 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aatcatggaagtctacagtt

SEQ ID NO: 47994 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcatggaagtctacagttgg

SEQ ID NO: 47995 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acagttgggagcaattgatt

SEQ ID NO: 47996 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cagttgggagcaattgattt

SEQ ID NO: 47997 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gttgggagcaattgatttgg

SEQ ID NO: 47998 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgggagcaattgatttggga

SEQ ID NO: 47999 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgatttgggagagaaaaact

SEQ ID NO: 48000 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atttgggagagaaaaactta

SEQ ID NO: 48001 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attgcatctttaactttaaa

SEQ ID NO: 48002 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgcatctttaactttaaat

SEQ ID NO: 48003 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcatctttaactttaaatag

SEQ ID NO: 48004 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aggagttcaaaaataaaaca

SEQ ID NO: 48005 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gttcaaaaataaaacatggt

SEQ ID NO: 48006 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caaaaataaaacatggtgag

SEQ ID NO: 48007 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaaataaaacatggtgagc

SEQ ID NO: 48008 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catggtgagcaggtgaacat

SEQ ID NO: 48009 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggtgagcaggtgaacatca

SEQ ID NO: 48010 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtgagcaggtgaacatcaga

SEQ ID NO: 48011 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atcagagagcctcttctctt

SEQ ID NO: 48012 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcagagagcctcttctcttc

SEQ ID NO: 48013 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcttctcttcaggccatccc

SEQ ID NO: 48014 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caggccatcccaagcacgca

SEQ ID NO: 48015 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcccaagcacgcatggaaaa

SEQ ID NO: 48016 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catggaaaacagtccatgtg

SEQ ID NO: 48017 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atggaaaacagtccatgtgc

SEQ ID NO: 48018 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggaaaacagtccatgtgcag

SEQ ID NO: 48019 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaacagtccatgtgcaggag

SEQ ID NO: 48020 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tccatgtgcaggagcagctt

SEQ ID NO: 48021 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agcagcttgagaaaacatta

SEQ ID NO: 48022 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaaaacattacagtatgtcc

SEQ ID NO: 48023 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtatgtcctggtacttaac

SEQ ID NO: 48024 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtatgtcctggtacttaact

SEQ ID NO: 48025 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggtacttaactaggacccca

SEQ ID NO: 48026 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtacttaactaggaccccat

SEQ ID NO: 48027 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
accccatgggatgatatact

SEQ ID NO: 48028 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccccatgggatgatatactc

SEQ ID NO: 48029 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catgggatgatatactcagg

SEQ ID NO: 48030 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgggatgatatactcagga

SEQ ID NO: 48031 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gatgatatactcaggaaggc

SEQ ID NO: 48032 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgatatactcaggaaggcga

SEQ ID NO: 48033 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
actcaggaaggcgagagatc

SEQ ID NO: 48034 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcaggaaggcgagagatcta

SEQ ID NO: 48035 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atctagagattaaatatgcc

SEQ ID NO: 48036 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagattaaatatgcccagaa

SEQ ID NO: 48037 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaatatgcccagaaaagat

SEQ ID NO: 48038 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagaaaattatttatgattc

SEQ ID NO: 48039 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcgagaactacccatattat

SEQ ID NO: 48040 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
actacccatattattagtga

SEQ ID NO: 48041 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctacccatattattagtgat

SEQ ID NO: 48042 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acccatattattagtgatgg

SEQ ID NO: 48043 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gagtaaaacacttataattt

SEQ ID NO: 48044 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acacttataattttggtaat

SEQ ID NO: 48045 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taattttggtaataagataa

SEQ ID NO: 48046 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attttggtaataagataata

SEQ ID NO: 48047 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaataaaaaacctcctaata

SEQ ID NO: 48048 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aataaaaaacctcctaatac

SEQ ID NO: 48049 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tacaggctcttaacatacac

SEQ ID NO: 48050 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acaggctcttaacatacacc

SEQ ID NO: 48051 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatacaatgcatgtttctct

SEQ ID NO: 48052 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttctcttggtactcacctgt

SEQ ID NO: 48053 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttggtactcacctgttggta

SEQ ID NO: 48054 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggtactcacctgttggtaa

SEQ ID NO: 48055 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cctgttggtaaaggttttcc

SEQ ID NO: 48056 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaggttttcccagtaatct

SEQ ID NO: 48057 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaggttttcccagtaatctt

SEQ ID NO: 48058 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcccagtaatcttgggtcat

SEQ ID NO: 48059 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttgggtcattagcctaaac

SEQ ID NO: 48060 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgggtcattagcctaaaca

SEQ ID NO: 48061 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcattagcctaaacaaggct

SEQ ID NO: 48062 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttagcctaaacaaggctaag

SEQ ID NO: 48063 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tagcctaaacaaggctaaga

SEQ ID NO: 48064 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaacaaggctaagaaggcc

SEQ ID NO: 48065 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggctaagaaggcccagctga

SEQ ID NO: 48066 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggcccagctgaaagtgtca

SEQ ID NO: 48067 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgaaagtgtcaaagctcgtg

SEQ ID NO: 48068 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaagctcgtgtagccataat

SEQ ID NO: 48069 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagctcgtgtagccataatc

SEQ ID NO: 48070 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agctcgtgtagccataatca

SEQ ID NO: 48071 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggtttctgccaattttcaca

SEQ ID NO: 48072 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtttctgccaattttcacac

SEQ ID NO: 48073 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcacacaggtgtacccctc

SEQ ID NO: 48074 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctggacactgactacacac

SEQ ID NO: 48075 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gacactgactacacacgaga

SEQ ID NO: 48076 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acacacgagaaagaacatta

SEQ ID NO: 48077 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cacacgagaaagaacattat

SEQ ID NO: 48078 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cgagaaagaacattataggt

SEQ ID NO: 48079 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaaagaacattataggtga

SEQ ID NO: 48080 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attataggtgagagtgtctt

SEQ ID NO: 48081 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttataggtgagagtgtcttc

SEQ ID NO: 48082 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgagagtgtcttcaggacac

SEQ ID NO: 48083 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcttcaggacacaagctaaa

SEQ ID NO: 48084 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agctaaatagccttactgaa

SEQ ID NO: 48085 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tactgaaaagttacaaactc

SEQ ID NO: 48086 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actgaaaagttacaaactca

SEQ ID NO: 48087 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caaactcaaggtttcttcta

SEQ ID NO: 48088 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaactcaaggtttcttctat

SEQ ID NO: 48089 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aactcaaggtttcttctata

SEQ ID NO: 48090 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
actcaaggtttcttctatag

SEQ ID NO: 48091 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctcaaggtttcttctatagg

SEQ ID NO: 48092 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atagggggacaatattgaat

SEQ ID NO: 48093 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tagggggacaatattgaata

SEQ ID NO: 48094 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gacaatattgaataaggatt

SEQ ID NO: 48095 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aggattaagaatacatgatt

SEQ ID NO: 48096 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgatttggctactgactact

SEQ ID NO: 48097 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgactttaccaaattcttc

SEQ ID NO: 48098 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgactttaccaaattcttca

SEQ ID NO: 48099 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taccaaattcttcaaggcat

SEQ ID NO: 48100 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cataagtctgtctgtgaaaa

SEQ ID NO: 48101 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ataagtctgtctgtgaaaat

SEQ ID NO: 48102 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggataataacatctacctc

SEQ ID NO: 48103 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacatctacctcaagaaaat

SEQ ID NO: 48104 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagaaaataagacttgtaat

SEQ ID NO: 48105 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gacttgtaataagtttaaat

SEQ ID NO: 48106 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gataatgtgtacaaattact

SEQ ID NO: 48107 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttagcttacatcctgcaca

SEQ ID NO: 48108 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcttacatcctgcacataga

SEQ ID NO: 48109 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agaaagtgtttaataaatca

SEQ ID NO: 48110 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taataaatcatagctgccat

SEQ ID NO: 48111 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcatcatcatcattaaaaca

SEQ ID NO: 48112 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaaacatggaaattttcaa

SEQ ID NO: 48113 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttcaacagacgttttgtga

SEQ ID NO: 48114 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agacgttttgtgatagttct

SEQ ID NO: 48115 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttttgtgatagttcttggtt

SEQ ID NO: 48116 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttcagtaaatattgatatg

SEQ ID NO: 48117 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttcagtaaatattgatatgt

SEQ ID NO: 48118 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgatatgtaggctgttacca

SEQ ID NO: 48119 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctttctgtctgtataattct

SEQ ID NO: 48120 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtctgtataattcttggaa

SEQ ID NO: 48121 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtataattcttggaatagat

SEQ ID NO: 48122 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ataattcttggaatagatta

SEQ ID NO: 48123 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaatagattagagtcaataa

SEQ ID NO: 48124 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtcaataatagtcaaaata

SEQ ID NO: 48125 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcaaaatatagtaattgtct

SEQ ID NO: 48126 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctaagttcataaaaatgtg

SEQ ID NO: 48127 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcataaaaatgtgcagcttt

SEQ ID NO: 48128 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gacttttttctttctaaaat

SEQ ID NO: 48129 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttttttctttctaaaattgg

SEQ ID NO: 48130 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctttctaaaattggtggac

SEQ ID NO: 48131 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttaaataaatacaatattct

SEQ ID NO: 48132 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaatattctgagattcttc

SEQ ID NO: 48133 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caatattctgagattcttct

SEQ ID NO: 48134 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttctgagattcttctgggaa

SEQ ID NO: 48135 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgggaacagcaaccttatc

SEQ ID NO: 48136 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccagtttattcctatgttgc

SEQ ID NO: 48137 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcctatgttgccagtgtaca

SEQ ID NO: 48138 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctatgttgccagtgtacaca

SEQ ID NO: 48139 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtacacagagcctgatgaa

SEQ ID NO: 48140 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgatgaatagatgtctgca

SEQ ID NO: 48141 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgatgaatagatgtctgcat

SEQ ID NO: 48142 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gatgaatagatgtctgcata

SEQ ID NO: 48143 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgaatagatgtctgcatag

SEQ ID NO: 48144 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgaatagatgtctgcatagg

SEQ ID NO: 48145 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agatgtctgcatagggggaa

SEQ ID NO: 48146 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtctgcatagggggaaaagc

SEQ ID NO: 48147 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgcatagggggaaaagcaa

SEQ ID NO: 48148 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gggaaaagcaagagcttatg

SEQ ID NO: 48149 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcagctgatgctacaaaatg

SEQ ID NO: 48150 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctgatgctacaaaatgaagt

SEQ ID NO: 48151 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctacaaaatgaagttggtgt

SEQ ID NO: 48152 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acaaaatgaagttggtgtaa

SEQ ID NO: 48153 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaatgaagttggtgtaaga

SEQ ID NO: 48154 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgaagttggtgtaagagag

SEQ ID NO: 48155 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagttggtgtaagagagaag

SEQ ID NO: 48156 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggtgtaagagagaagcagc

SEQ ID NO: 48157 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtaagagagaagcagcaaga

SEQ ID NO: 48158 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagagaagcagcaagatgga

SEQ ID NO: 48159 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcttaaaatatgtgtaccc

SEQ ID NO: 48160 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatatgtgtacccaagtcc

SEQ ID NO: 48161 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatatgtgtacccaagtcca

SEQ ID NO: 48162 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtccaaggaatccctttgct

SEQ ID NO: 48163 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccaaggaatccctttgctta

SEQ ID NO: 48164 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aggaatccctttgcttagag

SEQ ID NO: 48165 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtggccaaaacatgacatt

SEQ ID NO: 48166 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
catgacattcagtcacctat

SEQ ID NO: 48167 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acctatgagtcacatttaat

SEQ ID NO: 48168 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctatgagtcacatttaattg

SEQ ID NO: 48169 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtcacatttaattggagaat

SEQ ID NO: 48170 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acatttaattggagaatgag

SEQ ID NO: 48171 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attggagaatgagtggaact

SEQ ID NO: 48172 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttggagaatgagtggaactt

SEQ ID NO: 48173 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggagaatgagtggaacttgg

SEQ ID NO: 48174 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaatgagtggaacttgggag

SEQ ID NO: 48175 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagtggaacttgggagtaga

SEQ ID NO: 48176 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttgggagtagaaagaaaaa

SEQ ID NO: 48177 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctttgtgactcttcgttttc

SEQ ID NO: 48178 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgactcttcgttttccaga

SEQ ID NO: 48179 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actcttcgttttccagaaag

SEQ ID NO: 48180 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaaattatccaaccaacttt

SEQ ID NO: 48181 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attatccaaccaacttttgg

SEQ ID NO: 48182 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatccaaccaacttttggtg

SEQ ID NO: 48183 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caacttttggtggagttttc

SEQ ID NO: 48184 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttttggtggagttttctag

SEQ ID NO: 48185 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtaacattttctaccttctt

SEQ ID NO: 48186 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cttctgtcttgtgttaattc

SEQ ID NO: 48187 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaattcgagcactgtctca

SEQ ID NO: 48188 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtctcaaagtcttgctttc

SEQ ID NO: 48189 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctcaaagtcttgctttcaa

SEQ ID NO: 48190 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cattaactgtgaacatttta

SEQ ID NO: 48191 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
actgtgaacattttaaagac

SEQ ID NO: 48192 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttaaagactggatttgctg

SEQ ID NO: 48193 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttaaagactggatttgctgt

SEQ ID NO: 48194 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agactggatttgctgtggga

SEQ ID NO: 48195 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gatttgctgtgggacagaat

SEQ ID NO: 48196 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aataccatgaaatatataaa

SEQ ID NO: 48197 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaaatatataaaaagcaata

SEQ ID NO: 48198 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaaaagcaatatagaatca

SEQ ID NO: 48199 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acattcttttccttctcttt

SEQ ID NO: 48200 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttccttctctttcagcctt

SEQ ID NO: 48201 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctttcagcctttagactaaa

SEQ ID NO: 48202 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaatctgtgctgaaaccaca

SEQ ID NO: 48203 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatctgtgctgaaaccacaa

SEQ ID NO: 48204 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctgtgctgaaaccacaaag

SEQ ID NO: 48205 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtgctgaaaccacaaagga

SEQ ID NO: 48206 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
accacaaaggagagcatctt

SEQ ID NO: 48207 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagcatctttggatccttcc

SEQ ID NO: 48208 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtaataaaaatattctgttg

SEQ ID NO: 48209 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataaaaatattctgttgaag

SEQ ID NO: 48210 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgttgaagaagaatttgaa

SEQ ID NO: 48211 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttgaacagttataacatca

SEQ ID NO: 48212 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttaatctgtgattgtgata

SEQ ID NO: 48213 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttaatctgtgattgtgataa

SEQ ID NO: 48214 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatctgtgattgtgataaag

SEQ ID NO: 48215 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atctgtgattgtgataaagg

SEQ ID NO: 48216 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aggaggtaaattaattgata

SEQ ID NO: 48217 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tagacatttatctacaaatt

SEQ ID NO: 48218 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agacatttatctacaaattc

SEQ ID NO: 48219 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttatctacaaattcaggcc

SEQ ID NO: 48220 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tacaaattcaggcctggtcc

SEQ ID NO: 48221 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acaaattcaggcctggtccc

SEQ ID NO: 48222 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatatttattgataatctct

SEQ ID NO: 48223 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatttattgataatctctta

SEQ ID NO: 48224 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atttattgataatctcttag

SEQ ID NO: 48225 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attgataatctcttagaggc

SEQ ID NO: 48226 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgataatctcttagaggct

SEQ ID NO: 48227 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aacacgataaataaaatcat

SEQ ID NO: 48228 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aataaaatcattagttttat

SEQ ID NO: 48229 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatgagacctcctttatgtt

SEQ ID NO: 48230 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgagacctcctttatgttt

SEQ ID NO: 48231 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gacctcctttatgtttaggt

SEQ ID NO: 48232 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acctcctttatgtttaggtg

SEQ ID NO: 48233 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctcctttatgtttaggtga

SEQ ID NO: 48234 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cctttatgtttaggtgaggg

SEQ ID NO: 48235 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttatgtttaggtgagggtg

SEQ ID NO: 48236 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttatgtttaggtgagggtgg

SEQ ID NO: 48237 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttaggtgagggtggaggttg

SEQ ID NO: 48238 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtgagggtggaggttgtggt

SEQ ID NO: 48239 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgtggttggataaaaattt

SEQ ID NO: 48240 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagtaaataaataaatatac

SEQ ID NO: 48241 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ataaatatacaagatatttt

SEQ ID NO: 48242 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atatacaagatattttcaga

SEQ ID NO: 48243 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agatagtgataaatgatcta

SEQ ID NO: 48244 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgatctaaagaaaataaatt

SEQ ID NO: 48245 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gatctaaagaaaataaatta

SEQ ID NO: 48246 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaaaataaattaaggcaacg

SEQ ID NO: 48247 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aataaattaaggcaacgtgg

SEQ ID NO: 48248 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ataaattaaggcaacgtggt

SEQ ID NO: 48249 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaggcaacgtggtaggctg

SEQ ID NO: 48250 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcaacgtggtaggctgcagt

SEQ ID NO: 48251 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caacgtggtaggctgcagtc

SEQ ID NO: 48252 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aacgtggtaggctgcagtca

SEQ ID NO: 48253 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tggtaggctgcagtcaggga

SEQ ID NO: 48254 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagtcagggacggtctttct

SEQ ID NO: 48255 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtcagggacggtctttcta

SEQ ID NO: 48256 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcagggacggtctttctaag

SEQ ID NO: 48257 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaggagatgatatttaaact

SEQ ID NO: 48258 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgatatttaaactaagacct

SEQ ID NO: 48259 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actaagacctaagtgtgaca

SEQ ID NO: 48260 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagacctaagtgtgacaaag

SEQ ID NO: 48261 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cctaagtgtgacaaagaaga

SEQ ID NO: 48262 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaagacagccatgaaaatac

SEQ ID NO: 48263 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagccatgaaaatactggtg

SEQ ID NO: 48264 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gccatgaaaatactggtgaa

SEQ ID NO: 48265 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatactggtgaagagatatt

SEQ ID NO: 48266 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atactggtgaagagatattt

SEQ ID NO: 48267 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggtgaagagatatttgggc

SEQ ID NO: 48268 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggtgaagagatatttgggct

SEQ ID NO: 48269 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtgaagagatatttgggctg

SEQ ID NO: 48270 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgaagagatatttgggctgg

SEQ ID NO: 48271 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agagatatttgggctggggg

SEQ ID NO: 48272 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agatatttgggctgggggaa

SEQ ID NO: 48273 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atttgggctgggggaagaga

SEQ ID NO: 48274 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgggggaagagaaagaacta

SEQ ID NO: 48275 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agagaaagaactaaagccct

SEQ ID NO: 48276 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagaaagaactaaagcccta

SEQ ID NO: 48277 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaagaactaaagccctaagg

SEQ ID NO: 48278 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaactaaagccctaaggca

SEQ ID NO: 48279 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagccctaaggcagagatg

SEQ ID NO: 48280 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccctaaggcagagatgaagt

SEQ ID NO: 48281 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcagagatgaagttggtgtg

SEQ ID NO: 48282 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatgaagttggtgtgtggaa

SEQ ID NO: 48283 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagttggtgtgtggaaaagc

SEQ ID NO: 48284 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggtgtgtggaaaagccagc

SEQ ID NO: 48285 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtgtggaaaagccagcaaga

SEQ ID NO: 48286 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggaaaagccagcaagatggc

SEQ ID NO: 48287 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agccagcaagatggccagtg

SEQ ID NO: 48288 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caagatggccagtgtggcta

SEQ ID NO: 48289 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tggccagtgtggctacagtg

SEQ ID NO: 48290 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagtgtggctacagtgtggt

SEQ ID NO: 48291 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtgtggctacagtgtggtga

SEQ ID NO: 48292 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtggctacagtgtggtgag

SEQ ID NO: 48293 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtggctacagtgtggtgaga

SEQ ID NO: 48294 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggctacagtgtggtgagagg

SEQ ID NO: 48295 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gctacagtgtggtgagaggg

SEQ ID NO: 48296 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggtgagagggaggattgtga

SEQ ID NO: 48297 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagagggaggattgtgatgg

SEQ ID NO: 48298 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gagggaggattgtgatggca

SEQ ID NO: 48299 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agggaggattgtgatggcag

SEQ ID NO: 48300 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaggattgtgatggcagagg

SEQ ID NO: 48301 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aggattgtgatggcagaggt

SEQ ID NO: 48302 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attgtgatggcagaggtagg

SEQ ID NO: 48303 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgtgatggcagaggtaggc

SEQ ID NO: 48304 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgtgatggcagaggtaggca

SEQ ID NO: 48305 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtgatggcagaggtaggcag

SEQ ID NO: 48306 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tggcagaggtaggcaggggc

SEQ ID NO: 48307 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aggcaggggccggatcatgt

SEQ ID NO: 48308 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgtcggaatttgcatatca

SEQ ID NO: 48309 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatttgcatatcatagaaat

SEQ ID NO: 48310 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcatatcatagaaatgagtt

SEQ ID NO: 48311 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tagaaatgagtttggatttt

SEQ ID NO: 48312 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttggattttaagtatgatta

SEQ ID NO: 48313 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggattttaagtatgattaa

SEQ ID NO: 48314 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tttaagtatgattaaaggta

SEQ ID NO: 48315 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
taatgactgtgatacattct

SEQ ID NO: 48316 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cattctgagaaatgcatcat

SEQ ID NO: 48317 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attctgagaaatgcatcatt

SEQ ID NO: 48318 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcgtccttgtgcaaacatcc

SEQ ID NO: 48319 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cgtccttgtgcaaacatcct

SEQ ID NO: 48320 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtccttgtgcaaacatccta

SEQ ID NO: 48321 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agggtgcacttatacaaacc

SEQ ID NO: 48322 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgcacttatacaaacctaga

SEQ ID NO: 48323 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttatacaaacctagatggta

SEQ ID NO: 48324 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatacaaacctagatggtat

SEQ ID NO: 48325 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggtataggctaccatacacc

SEQ ID NO: 48326 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtataggctaccatacacct

SEQ ID NO: 48327 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taccatacacctaggctatg

SEQ ID NO: 48328 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacacctaggctatgtggta

SEQ ID NO: 48329 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtggtatagcctattgctcc

SEQ ID NO: 48330 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tggtatagcctattgctcct

SEQ ID NO: 48331 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gctcctgggctgcaaacctg

SEQ ID NO: 48332 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcctgggctgcaaacctgta

SEQ ID NO: 48333 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgggctgcaaacctgtagag

SEQ ID NO: 48334 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gggctgcaaacctgtagagt

SEQ ID NO: 48335 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggctactgtactcaatattg

SEQ ID NO: 48336 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gctactgtactcaatattgt

SEQ ID NO: 48337 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtaggcaactgttatacaa

SEQ ID NO: 48338 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggcaactgttatacaatgga

SEQ ID NO: 48339 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caatggaaagtgtgtatcta

SEQ ID NO: 48340 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggaaagtgtgtatctaaaga

SEQ ID NO: 48341 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgtgtatctaaagacagaa

SEQ ID NO: 48342 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtgtatctaaagacagaaa

SEQ ID NO: 48343 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atctaaagacagaaaaggta

SEQ ID NO: 48344 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaggtacagtaaaaaaata

SEQ ID NO: 48345 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atacagtattataatcttat

SEQ ID NO: 48346 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgagatcaccattatatata

SEQ ID NO: 48347 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgactaaaacatccttatg

SEQ ID NO: 48348 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ccttatgtggtacaatactc

SEQ ID NO: 48349 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatgtggtacaatactccgg

SEQ ID NO: 48350 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtggtacaatactccggaa

SEQ ID NO: 48351 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtggtacaatactccggaag

SEQ ID NO: 48352 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtacaatactccggaagagg

SEQ ID NO: 48353 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tactccggaagaggcagact

SEQ ID NO: 48354 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccggaagaggcagactcagt

SEQ ID NO: 48355 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cggaagaggcagactcagta

SEQ ID NO: 48356 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aagaggcagactcagtaagg

SEQ ID NO: 48357 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actcagtaaggcagtaacat

SEQ ID NO: 48358 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtaaggcagtaacataagt

SEQ ID NO: 48359 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttatcttacttttcattcac

SEQ ID NO: 48360 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttcaccagtccatacttact

SEQ ID NO: 48361 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcaccagtccatacttactt

SEQ ID NO: 48362 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacttaggacctactaattc

SEQ ID NO: 48363 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acttaggacctactaattct

SEQ ID NO: 48364 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acctactaattctaggtgtt

SEQ ID NO: 48365 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cctactaattctaggtgttg

SEQ ID NO: 48366 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tactaattctaggtgttgag

SEQ ID NO: 48367 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agatgacaatgtaatcaatg

SEQ ID NO: 48368 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttccatgtttcacctttca

SEQ ID NO: 48369 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtattctttgtgctaatttt

SEQ ID NO: 48370 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttctttgtgctaatttttag

SEQ ID NO: 48371 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtgctaatttttagtagtaa

SEQ ID NO: 48372 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctcttctgtcatttgctgtt

SEQ ID NO: 48373 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcttctgtcatttgctgtta

SEQ ID NO: 48374 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgctgttaaggcttgttcct

SEQ ID NO: 48375 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttaaggcttgttcctaagac

SEQ ID NO: 48376 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taaggcttgttcctaagact

SEQ ID NO: 48377 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaggcttgttcctaagactg

SEQ ID NO: 48378 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aggcttgttcctaagactgg

SEQ ID NO: 48379 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttgttcctaagactggggg

SEQ ID NO: 48380 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggggcagatctatccttgta

SEQ ID NO: 48381 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaaatatctattctactat

SEQ ID NO: 48382 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acctgacttcctattttact

SEQ ID NO: 48383 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cctgacttcctattttactc

SEQ ID NO: 48384 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaattaaaaaatctgattat

SEQ ID NO: 48385 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aattaaaaaatctgattatt

SEQ ID NO: 48386 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttaaaaaatctgattattgg

SEQ ID NO: 48387 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctgattattgggagacttt

SEQ ID NO: 48388 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgattattgggagacttttg

SEQ ID NO: 48389 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggagacttttggagtaatca

SEQ ID NO: 48390 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gacttttggagtaatcatgg

SEQ ID NO: 48391 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttggagtaatcatggaaga

SEQ ID NO: 48392 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tggaagaaagactatgaaat

SEQ ID NO: 48393 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
actatgaaatcagatattct

SEQ ID NO: 48394 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgttgcttctatcccttctt

SEQ ID NO: 48395 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcttctatcccttcttaagt

SEQ ID NO: 48396 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taagtaagtgaattatcttt

SEQ ID NO: 48397 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaattatctttaagccatt

SEQ ID NO: 48398 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atctttaagccattaagcct

SEQ ID NO: 48399 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgcatctgtaaaatacgtat

SEQ ID NO: 48400 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataagaatacctactttata

SEQ ID NO: 48401 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tactttataaagttgttaaa

SEQ ID NO: 48402 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagttgttaaatagtataaa

SEQ ID NO: 48403 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agttgttaaatagtataaat

SEQ ID NO: 48404 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtgatccacacattctgtac

SEQ ID NO: 48405 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgtactagctgctcaaaaa

SEQ ID NO: 48406 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtactagctgctcaaaaac

SEQ ID NO: 48407 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tactagctgctcaaaaacag

SEQ ID NO: 48408 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaacaggagttattataat

SEQ ID NO: 48409 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gttaaactattatacaattt

SEQ ID NO: 48410 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catcatcattttatcttact

SEQ ID NO: 48411 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catcattttatcttacttag

SEQ ID NO: 48412 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttatcttacttagaagaca

SEQ ID NO: 48413 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagacacagataaaacaata

SEQ ID NO: 48414 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gataaaacaataaagccttg

SEQ ID NO: 48415 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acaataaagccttgcagttt

SEQ ID NO: 48416 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caataaagccttgcagtttg

SEQ ID NO: 48417 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgcagtttgaggtgcaaatg

SEQ ID NO: 48418 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcagtttgaggtgcaaatgt

SEQ ID NO: 48419 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taggtgaaaatgtgcatgaa

SEQ ID NO: 48420 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ctgaaaacactcctgaacct

SEQ ID NO: 48421 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgaaaacactcctgaacctc

SEQ ID NO: 48422 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaacactcctgaacctcggg

SEQ ID NO: 48423 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aacactcctgaacctcggga

SEQ ID NO: 48424 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctcctgaacctcgggaagga

SEQ ID NO: 48425 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcctgaacctcgggaaggat

SEQ ID NO: 48426 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aacctcgggaaggatgggcc

SEQ ID NO: 48427 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctcgggaaggatgggcctgg

SEQ ID NO: 48428 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cgggaaggatgggcctggta

SEQ ID NO: 48429 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaggatgggcctggtagagt

SEQ ID NO: 48430 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgggcctggtagagtgagta

SEQ ID NO: 48431 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gggcctggtagagtgagtat

SEQ ID NO: 48432 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcctggtagagtgagtatgg

SEQ ID NO: 48433 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctggtagagtgagtatggga

SEQ ID NO: 48434 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggtagagtgagtatgggag

SEQ ID NO: 48435 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagtgagtatgggagaggat

SEQ ID NO: 48436 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacatccaaaatattttaat

SEQ ID NO: 48437 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acatccaaaatattttaata

SEQ ID NO: 48438 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccaaaatattttaataagga

SEQ ID NO: 48439 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttaataaggatggattactt

SEQ ID NO: 48440 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attatcctttaaactaatgc

SEQ ID NO: 48441 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gttcacatttatcaaccact

SEQ ID NO: 48442 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttcacatttatcaaccactg

SEQ ID NO: 48443 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cacatttatcaaccactgag

SEQ ID NO: 48444 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaggagctgaattatatgaa

SEQ ID NO: 48445 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aggagctgaattatatgaat

SEQ ID NO: 48446 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgaattatatgaatgggctc

SEQ ID NO: 48447 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aattatatgaatgggctctg

SEQ ID NO: 48448 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgggctctggagctgtctat

SEQ ID NO: 48449 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctatactactgtatttaaca

SEQ ID NO: 48450 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tactgtatttaacacagtat

SEQ ID NO: 48451 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acacagtataagaatgatga

SEQ ID NO: 48452 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cacagtataagaatgatgaa

SEQ ID NO: 48453 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tataagaatgatgaaaggta

SEQ ID NO: 48454 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgatgaaaggtaaagcaatg

SEQ ID NO: 48455 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gatgaaaggtaaagcaatgc

SEQ ID NO: 48456 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaaaggtaaagcaatgcagg

SEQ ID NO: 48457 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcaatgcaggtagctcactc

SEQ ID NO: 48458 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caatgcaggtagctcactct

SEQ ID NO: 48459 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggtagctcactctaggtttg

SEQ ID NO: 48460 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tacaataatttctaaacaac

SEQ ID NO: 48461 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caactagacattaaattatt

SEQ ID NO: 48462 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagacattaaattattaaga

SEQ ID NO: 48463 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cattaaattattaagatggt

SEQ ID NO: 48464 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttattaagatggttggcttc

SEQ ID NO: 48465 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaagatggttggcttcaag

SEQ ID NO: 48466 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggttggcttcaagaagattt

SEQ ID NO: 48467 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gttggcttcaagaagattta

SEQ ID NO: 48468 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaggttaacatctttaaaaa

SEQ ID NO: 48469 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aggttaacatctttaaaaat

SEQ ID NO: 48470 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgggaaaaaattgaatgca

SEQ ID NO: 48471 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tattgcttgtgcatattcaa

SEQ ID NO: 48472 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgcttgtgcatattcaaaag

SEQ ID NO: 48473 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcttgtgcatattcaaaagt

SEQ ID NO: 48474 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaaagtgggatgattctga

SEQ ID NO: 48475 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgggatgattctgaaagata

SEQ ID NO: 48476 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gaaagataaagaatgaatca

SEQ ID NO: 48477 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gataaagaatgaatcacggc

SEQ ID NO: 48478 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ataaagaatgaatcacggcc

SEQ ID NO: 48479 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaatgaatcacggccgggcg

SEQ ID NO: 48480 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgaatcacggccgggcgcag

SEQ ID NO: 48481 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtggctcacgcctgtaatgc

SEQ ID NO: 48482 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgcctgtaatgccagcactt

SEQ ID NO: 48483 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcctgtaatgccagcacttt

SEQ ID NO: 48484 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgtaatgccagcactttgg

SEQ ID NO: 48485 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtaatgccagcactttggg

SEQ ID NO: 48486 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgccagcactttgggaggtc

SEQ ID NO: 48487 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gccagcactttgggaggtcg

SEQ ID NO: 48488 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
agcactttgggaggtcgagg

SEQ ID NO: 48489 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gcactttgggaggtcgaggc

SEQ ID NO: 48490 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctttgggaggtcgaggcggg

SEQ ID NO: 48491 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggtcgaggcgggcagatcac

SEQ ID NO: 48492 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtcgaggcgggcagatcacg

SEQ ID NO: 48493 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aggcgggcagatcacgaggt

SEQ ID NO: 48494 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggcgggcagatcacgaggtc

SEQ ID NO: 48495 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cgggcagatcacgaggtcag

SEQ ID NO: 48496 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gatcacgaggtcaggagatc

SEQ ID NO: 48497 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcaggagatcgagaccatcc

SEQ ID NO: 48498 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctactaaaaatacaaaaaaa

SEQ ID NO: 48499 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taaaaatacaaaaaaatagc

SEQ ID NO: 48500 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaaaatacaaaaaaatagct

SEQ ID NO: 48501 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tacaaaaaaatagctgggcg

SEQ ID NO: 48502 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaaaaatagctgggcgtgg

SEQ ID NO: 48503 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aaaatagctgggcgtggtgg

SEQ ID NO: 48504 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaatagctgggcgtggtggc

SEQ ID NO: 48505 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggcgtggtggcgggcacctg

SEQ ID NO: 48506 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtggcgggcacctgtagtcc

SEQ ID NO: 48507 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cacctgtagtcccagctact

SEQ ID NO: 48508 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgtagtcccagctacttgg

SEQ ID NO: 48509 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtagtcccagctacttggc

SEQ ID NO: 48510 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcccagctacttggcaggct

SEQ ID NO: 48511 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccagctacttggcaggctg

SEQ ID NO: 48512 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agctacttggcaggctgagg

SEQ ID NO: 48513 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gctacttggcaggctgaggc

SEQ ID NO: 48514 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tacttggcaggctgaggcag

SEQ ID NO: 48515 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggcaggctgaggcaggagaa

SEQ ID NO: 48516 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gcaggagaatggtgtgaacc

SEQ ID NO: 48517 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caggagaatggtgtgaaccc

SEQ ID NO: 48518 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggagaatggtgtgaacccgg

SEQ ID NO: 48519 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagaatggtgtgaacccggg

SEQ ID NO: 48520 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aatggtgtgaacccgggagg

SEQ ID NO: 48521 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tggtgtgaacccgggaggcg

SEQ ID NO: 48522 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacccgggaggcggagctta

SEQ ID NO: 48523 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cgggaggcggagcttacagt

SEQ ID NO: 48524 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggcggagcttacagtgagcc

SEQ ID NO: 48525 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagcttacagtgagccgaga

SEQ ID NO: 48526 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gagatagcgacactgcattc

SEQ ID NO: 48527 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agcgacactgcattccagcc

SEQ ID NO: 48528 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcgacactgcattccagcct

SEQ ID NO: 48529 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgcattccagcctaggcga

SEQ ID NO: 48530 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcattccagcctaggcgaca

SEQ ID NO: 48531 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tccagcctaggcgacagagt

SEQ ID NO: 48532 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaaaaaaaaaaaaaaaaa

SEQ ID NO: 48533 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaaaaaaagaaccatgact

SEQ ID NO: 48534 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgactcagtaatcccactac

SEQ ID NO: 48535 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gactcagtaatcccactact

SEQ ID NO: 48536 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cccactactaggtatatact

SEQ ID NO: 48537 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aacttgtacatgaatgttta

SEQ ID NO: 48538 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acattatgcattataaccaa

SEQ ID NO: 48539 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tatgcattataaccaaaaga

SEQ ID NO: 48540 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgaatgtataaacaaaata

SEQ ID NO: 48541 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acatacaatgaaatatcatt

SEQ ID NO: 48542 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatatcatttagcaataaa

SEQ ID NO: 48543 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttagcaataaaaagaaatg

SEQ ID NO: 48544 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caataaaaagaaatgaagca

SEQ ID NO: 48545 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
catagatacatactatacca

SEQ ID NO: 48546 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaattttgaaaacattatgc

SEQ ID NO: 48547 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aattttgaaaacattatgct

SEQ ID NO: 48548 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaaacattatgctaggtgt

SEQ ID NO: 48549 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacattatgctaggtgtaag

SEQ ID NO: 48550 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttatgctaggtgtaagaagc

SEQ ID NO: 48551 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtaagaagccagatacaaa

SEQ ID NO: 48552 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttccatgtatattaaatcta

SEQ ID NO: 48553 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccatgtatattaaatctaca

SEQ ID NO: 48554 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtatattaaatctacagag

SEQ ID NO: 48555 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtatattaaatctacagagt

SEQ ID NO: 48556 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctacagagtgggtaaatccc

SEQ ID NO: 48557 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tacagagtgggtaaatccct

SEQ ID NO: 48558 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acagagtgggtaaatcccta

SEQ ID NO: 48559 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtgggtaaatccctaggga

SEQ ID NO: 48560 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggtaaatccctagggacaga

SEQ ID NO: 48561 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatccctagggacagaaag

SEQ ID NO: 48562 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cctagggacagaaagtagat

SEQ ID NO: 48563 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agggacagaaagtagattag

SEQ ID NO: 48564 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaaagtagattagtggttgc

SEQ ID NO: 48565 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaagtagattagtggttgcc

SEQ ID NO: 48566 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aagtagattagtggttgcca

SEQ ID NO: 48567 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agtagattagtggttgccag

SEQ ID NO: 48568 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gattagtggttgccaggggc

SEQ ID NO: 48569 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
attagtggttgccaggggct

SEQ ID NO: 48570 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tagtggttgccaggggctgg

SEQ ID NO: 48571 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttgccaggggctgggagaa

SEQ ID NO: 48572 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgccaggggctgggagaaa

SEQ ID NO: 48573 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgccaggggctgggagaaaa

SEQ ID NO: 48574 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gggctgggagaaaagggaaa

SEQ ID NO: 48575 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggctgggagaaaagggaaat

SEQ ID NO: 48576 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gctgggagaaaagggaaatg

SEQ ID NO: 48577 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aaatggggaatgactactaa

SEQ ID NO: 48578 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aatggggaatgactactaac

SEQ ID NO: 48579 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gaatgactactaacgggccc

SEQ ID NO: 48580 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aatgactactaacgggccct

SEQ ID NO: 48581 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctaacgggccctgggtttct

SEQ ID NO: 48582 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acgggccctgggtttcttgg

SEQ ID NO: 48583 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cgggccctgggtttcttggt

SEQ ID NO: 48584 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccctgggtttcttggtggga

SEQ ID NO: 48585 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagatgaaaatattttaaat

SEQ ID NO: 48586 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgaaaatattttaaattaga

SEQ ID NO: 48587 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaatattttaaattagatag

SEQ ID NO: 48588 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggcgatcgttgcacaactct

SEQ ID NO: 48589 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcgttgcacaactctgagta

SEQ ID NO: 48590 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgagtatagtttaaaaaat

SEQ ID NO: 48591 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agtttaaaaaatgagttata

SEQ ID NO: 48592 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgagttatacagtttaaaaa

SEQ ID NO: 48593 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagttatacagtttaaaaaa

SEQ ID NO: 48594 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtttaaaaaaaggaattttg

SEQ ID NO: 48595 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctcaataaacctatttttaa

SEQ ID NO: 48596 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcaataaacctatttttaaa

SEQ ID NO: 48597 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caataaacctatttttaaaa

SEQ ID NO: 48598 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cctatttttaaaagggaatg

SEQ ID NO: 48599 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
taaaagggaatgcagcataa

SEQ ID NO: 48600 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gggaatgcagcataacggca

SEQ ID NO: 48601 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggaatgcagcataacggcaa

SEQ ID NO: 48602 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cagcataacggcaaaggttg

SEQ ID NO: 48603 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agcataacggcaaaggttgt

SEQ ID NO: 48604 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ataacggcaaaggttgtggg

SEQ ID NO: 48605 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taacggcaaaggttgtgggt

SEQ ID NO: 48606 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aacggcaaaggttgtgggtg

SEQ ID NO: 48607 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acggcaaaggttgtgggtgg

SEQ ID NO: 48608 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acttatcactaaaatacgta

SEQ ID NO: 48609 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cttatcactaaaatacgtat

SEQ ID NO: 48610 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttatcactaaaatacgtatg

SEQ ID NO: 48611 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaattgatataacaaaaata

SEQ ID NO: 48612 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattgatattaaatctaatg

SEQ ID NO: 48613 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attaaatctaatgaagattc

SEQ ID NO: 48614 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttaaatctaatgaagattct

SEQ ID NO: 48615 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctaatgaagattctgggtg

SEQ ID NO: 48616 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagtttttaaattaattttc

SEQ ID NO: 48617 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attaattttcaagattaatg

SEQ ID NO: 48618 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcaagattaatgtagcaaaa

SEQ ID NO: 48619 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagcaaaatagaaaaaaaaa

SEQ ID NO: 48620 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atggtaattctgcccttgct

SEQ ID NO: 48621 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taattctgcccttgctcaga

SEQ ID NO: 48622 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caacttatgacaattgtgta

SEQ ID NO: 48623 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatgacaattgtgtatggct

SEQ ID NO: 48624 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atgacaattgtgtatggctt

SEQ ID NO: 48625 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgtgtatggcttgggccta

SEQ ID NO: 48626 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgtatggcttgggcctatgg

SEQ ID NO: 48627 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggcttgggcctatggaagtg

SEQ ID NO: 48628 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cttgggcctatggaagtgaa

SEQ ID NO: 48629 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaagagtatatccccaacg

SEQ ID NO: 48630 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaagagtatatccccaacga

SEQ ID NO: 48631 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aagagtatatccccaacgaa

SEQ ID NO: 48632 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agggcaaataatgcaactct

SEQ ID NO: 48633 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taatgcaactctgagaaaac

SEQ ID NO: 48634 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caactctgagaaaactagtg

SEQ ID NO: 48635 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aactctgagaaaactagtgc

SEQ ID NO: 48636 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
actctgagaaaactagtgca

SEQ ID NO: 48637 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctctgagaaaactagtgcag

SEQ ID NO: 48638 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaaaactagtgcaggggat

SEQ ID NO: 48639 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaaactagtgcaggggatc

SEQ ID NO: 48640 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctagtgcaggggatcaggac

SEQ ID NO: 48641 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tagtgcaggggatcaggact

SEQ ID NO: 48642 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgcaggggatcaggactggg

SEQ ID NO: 48643 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caggggatcaggactgggca

SEQ ID NO: 48644 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aggggatcaggactgggcag

SEQ ID NO: 48645 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggggatcaggactgggcaga

SEQ ID NO: 48646 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcacatgatactctacactc

SEQ ID NO: 48647 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
actctacactctggcaaatg

SEQ ID NO: 48648 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctggcaaatgtagttctcac

SEQ ID NO: 48649 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgtagttctcacaagaaaa

SEQ ID NO: 48650 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttctcacaagaaaacagctg

SEQ ID NO: 48651 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caagaaaacagctgtagatg

SEQ ID NO: 48652 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagaaaacagctgtagatga

SEQ ID NO: 48653 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaaaacagctgtagatgaag

SEQ ID NO: 48654 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acagctgtagatgaaggaga

SEQ ID NO: 48655 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagctgtagatgaaggagat

SEQ ID NO: 48656 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggagataggaaaattcctgt

SEQ ID NO: 48657 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gataggaaaattcctgttag

SEQ ID NO: 48658 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaaattcctgttagtagtg

SEQ ID NO: 48659 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaattcctgttagtagtga

SEQ ID NO: 48660 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
agtagtgaaggccaatattg

SEQ ID NO: 48661 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctctattaaatgtcaaatat

SEQ ID NO: 48662 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatgtcaaatattagaaaaa

SEQ ID NO: 48663 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgtcaaatattagaaaaac

SEQ ID NO: 48664 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtcaaatattagaaaaacag

SEQ ID NO: 48665 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcaaatattagaaaaacagg

SEQ ID NO: 48666 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatattagaaaaacaggagg

SEQ ID NO: 48667 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tattagaaaaacaggaggaa

SEQ ID NO: 48668 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aggaagagaatatcctgttt

SEQ ID NO: 48669 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttttagcccaatataacca

SEQ ID NO: 48670 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctccataatactgcacatt

SEQ ID NO: 48671 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgaaccccactttcatctg

SEQ ID NO: 48672 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaccccactttcatctgtag

SEQ ID NO: 48673 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcatctgtagcagcataaaa

SEQ ID NO: 48674 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agcataaaaaagtgtttgat

SEQ ID NO: 48675 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagtgtttgatgagcatca

SEQ ID NO: 48676 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gtgtttgatgagcatcaaag

SEQ ID NO: 48677 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgatgagcatcaaagtaga

SEQ ID NO: 48678 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaagtagacagcaacacca

SEQ ID NO: 48679 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaagtagacagcaacaccaa

SEQ ID NO: 48680 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctacaaattgtatgttttt

SEQ ID NO: 48681 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acaaattgtatgtttttcag

SEQ ID NO: 48682 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caaattgtatgtttttcagc

SEQ ID NO: 48683 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aattgtatgtttttcagcag

SEQ ID NO: 48684 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attgtatgtttttcagcagg

SEQ ID NO: 48685 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatgtttttcagcaggaggt

SEQ ID NO: 48686 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttttcagcaggaggtgaga

SEQ ID NO: 48687 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcagcaggaggtgagacag

SEQ ID NO: 48688 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcagcaggaggtgagacagt

SEQ ID NO: 48689 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatttatttgattgtgaatt

SEQ ID NO: 48690 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatttgattgtgaatttgga

SEQ ID NO: 48691 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atttgattgtgaatttggaa

SEQ ID NO: 48692 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gtgaatttggaaaggcattt

SEQ ID NO: 48693 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttcggaaaatactttgcta

SEQ ID NO: 48694 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttcggaaaatactttgctat

SEQ ID NO: 48695 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaatactttgctataggcac

SEQ ID NO: 48696 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taggcaccagaaaatgcttt

SEQ ID NO: 48697 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaatgcttttagattatgct

SEQ ID NO: 48698 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatgcttttagattatgctc

SEQ ID NO: 48699 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttatgctcaggttctctgtg

SEQ ID NO: 48700 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tattgccaattcatttgcct

SEQ ID NO: 48701 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttctcatgatctatcaacc

SEQ ID NO: 48702 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agttcttgtcactctttgta

SEQ ID NO: 48703 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctttgtacagcttaaatcca

SEQ ID NO: 48704 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttgtacagcttaaatccat

SEQ ID NO: 48705 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccatgggcattcattatcat

SEQ ID NO: 48706 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attatcatcagtgcctaacc

SEQ ID NO: 48707 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atcatcagtgcctaacctgg

SEQ ID NO: 48708 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgcctaacctggcagaacca

SEQ ID NO: 48709 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
accacagtctacacataatc

SEQ ID NO: 48710 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggcatctgtcttttccatgc

SEQ ID NO: 48711 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttccatgctggctaccaaa

SEQ ID NO: 48712 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gctaccaaatggctgaatgt

SEQ ID NO: 48713 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
accaaatggctgaatgttgg

SEQ ID NO: 48714 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caaatggctgaatgttggtg

SEQ ID NO: 48715 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtggagaaactctcacaacc

SEQ ID NO: 48716 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aactctcacaaccaagtgaa

SEQ ID NO: 48717 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caagtgaatggttatatttt

SEQ ID NO: 48718 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaatggttatattttaagt

SEQ ID NO: 48719 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cattctcatcaaatcatctg

SEQ ID NO: 48720 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcttcctcatttgcactct

SEQ ID NO: 48721 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcttcctcatttgcactctc

SEQ ID NO: 48722 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atgatcccatcttatacttt

SEQ ID NO: 48723 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgatcccatcttatactttg

SEQ ID NO: 48724 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttgaggaaataaaaaccat

SEQ ID NO: 48725 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttgaggaaataaaaaccatt

SEQ ID NO: 48726 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atcatcttttgataactctg

SEQ ID NO: 48727 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ttctatctttcctcctgttt

SEQ ID NO: 48728 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tatctttcctcctgtttcgg

SEQ ID NO: 48729 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctttcctcctgtttcggtg

SEQ ID NO: 48730 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctttactctttcactttcac

SEQ ID NO: 48731 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttactctttcactttcacg

SEQ ID NO: 48732 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aactactcattcattatcac

SEQ ID NO: 48733 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccatatatttttttaaatgc

SEQ ID NO: 48734 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cattattctgcttcccttta

SEQ ID NO: 48735 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccctttatagccaaatttct

SEQ ID NO: 48736 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctttatagccaaatttctt

SEQ ID NO: 48737 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tttatagccaaatttcttgg

SEQ ID NO: 48738 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccacttacccaaattttctc

SEQ ID NO: 48739 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atccttactccttgatcttg

SEQ ID NO: 48740 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttgcagcatgattctacac

SEQ ID NO: 48741 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tacaatatgttttcttctct

SEQ ID NO: 48742 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atctttgcttcttactttat

SEQ ID NO: 48743 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tttgcttcttactttattgg

SEQ ID NO: 48744 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tctttctctgtgttcttttc

SEQ ID NO: 48745 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctttctctgtgttcttttct

SEQ ID NO: 48746 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tctacctgaattctaaatgt

SEQ ID NO: 48747 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tacctgaattctaaatgtca

SEQ ID NO: 48748 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aattctaaatgtcagagttg

SEQ ID NO: 48749 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aatgtcagagttgtagatct

SEQ ID NO: 48750 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agagttgtagatcttggtac

SEQ ID NO: 48751 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taccagattgctttaaatac

SEQ ID NO: 48752 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
accagattgctttaaatacc

SEQ ID NO: 48753 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctctatctacttaaaaatat

SEQ ID NO: 48754 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctatctacttaaaaatatc

SEQ ID NO: 48755 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctatctacttaaaaatatca

SEQ ID NO: 48756 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttaaaaatatcagggatgtt

SEQ ID NO: 48757 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaaatatcagggatgttca

SEQ ID NO: 48758 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaatatcagggatgttcag

SEQ ID NO: 48759 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atatcagggatgttcagagg

SEQ ID NO: 48760 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atcagggatgttcagaggta

SEQ ID NO: 48761 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcagggatgttcagaggtag

SEQ ID NO: 48762 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttctttttgctgattgctc

SEQ ID NO: 48763 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctggaatttatctccaaact

SEQ ID NO: 48764 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaatttatctccaaactcag

SEQ ID NO: 48765 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatttatctccaaactcagc

SEQ ID NO: 48766 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctctatattatatatccacc

SEQ ID NO: 48767 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatccacctggacatctca

SEQ ID NO: 48768 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatccacctggacatctcaa

SEQ ID NO: 48769 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaggcatctcattttaattt

SEQ ID NO: 48770 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catctcattttaattttagc

SEQ ID NO: 48771 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttaattttagctagctaa

SEQ ID NO: 48772 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attaaccatcaccacccatc

SEQ ID NO: 48773 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caccacccatccagttattg

SEQ ID NO: 48774 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acccatccagttattgcagc

SEQ ID NO: 48775 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agttattgcagccagaaact

SEQ ID NO: 48776 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tattgcagccagaaactgag

SEQ ID NO: 48777 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcctgtcttctttaatccat

SEQ ID NO: 48778 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtcttctttaatccatcagc

SEQ ID NO: 48779 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taatccatcagcaagctcta

SEQ ID NO: 48780 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctctacagactttgtatgtt

SEQ ID NO: 48781 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcatttctctgccatcactc

SEQ ID NO: 48782 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aacctttattttctcttgcc

SEQ ID NO: 48783 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttattttctcttgcctagat

SEQ ID NO: 48784 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attttctcttgcctagatga

SEQ ID NO: 48785 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttctcttgcctagatgagag

SEQ ID NO: 48786 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
accatctacccttgctcaat

SEQ ID NO: 48787 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgctcaatcagttgtgcac

SEQ ID NO: 48788 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcaatcagttgtgcacaaga

SEQ ID NO: 48789 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcagttgtgcacaagacaga

SEQ ID NO: 48790 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaaatacaaactccttccca

SEQ ID NO: 48791 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaatacaaactccttcccat

SEQ ID NO: 48792 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acccataccctccctttatt

SEQ ID NO: 48793 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cccataccctccctttattc

SEQ ID NO: 48794 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catgctatttctcctaattg

SEQ ID NO: 48795 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gctatttctcctaattgaag

SEQ ID NO: 48796 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaagcagcaccccccacaca

SEQ ID NO: 48797 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cccacacttaaactatttta

SEQ ID NO: 48798 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tatggcttcttactatcttt

SEQ ID NO: 48799 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcttactatcttttagatct

SEQ ID NO: 48800 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagcttaaatgccatcacct

SEQ ID NO: 48801 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcttaaatgccatcacctca

SEQ ID NO: 48802 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctcagagatgtcttctcatc

SEQ ID NO: 48803 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttctcatctagttgatatct

SEQ ID NO: 48804 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tagttgatatctcagcacct

SEQ ID NO: 48805 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgagactcacttcctttgca

SEQ ID NO: 48806 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
catggcatttattataactt

SEQ ID NO: 48807 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acattttttttcattcccac

SEQ ID NO: 48808 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttcattcccactagatgat

SEQ ID NO: 48809 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctagatgataagctctgtga

SEQ ID NO: 48810 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgataagctctgtgaaagc

SEQ ID NO: 48811 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgataagctctgtgaaagca

SEQ ID NO: 48812 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gataagctctgtgaaagcaa

SEQ ID NO: 48813 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gctctgtgaaagcaagggct

SEQ ID NO: 48814 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctctgtgaaagcaagggctg

SEQ ID NO: 48815 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gaggctatcatttattgcta

SEQ ID NO: 48816 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatcatttattgctatagct

SEQ ID NO: 48817 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atcatttattgctatagctc

SEQ ID NO: 48818 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcatttattgctatagctca

SEQ ID NO: 48819 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataaacgcaccaataaatga

SEQ ID NO: 48820 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaaagtttgaatcaattatg

SEQ ID NO: 48821 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atcaattatgcagtcaaaaa

SEQ ID NO: 48822 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caaaaatggcttctatgaca

SEQ ID NO: 48823 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaaatggcttctatgacat

SEQ ID NO: 48824 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggcttctatgacataggaaa

SEQ ID NO: 48825 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttctatgacataggaaacag

SEQ ID NO: 48826 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taggaaacagaagcaaaatt

SEQ ID NO: 48827 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcttcactaaaactacattt

SEQ ID NO: 48828 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcactaaaactacatttcag

SEQ ID NO: 48829 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctacatttcagaagaaaata

SEQ ID NO: 48830 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaaaataaagaataatgta

SEQ ID NO: 48831 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taaagaataatgtacagatt

SEQ ID NO: 48832 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agaataatgtacagatttgg

SEQ ID NO: 48833 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taatgtacagatttggaaga

SEQ ID NO: 48834 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatgtacagatttggaagac

SEQ ID NO: 48835 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agatttggaagacaggattg

SEQ ID NO: 48836 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggaagacaggattgtggtat

SEQ ID NO: 48837 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtggtataagattcattat

SEQ ID NO: 48838 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tcatgtttaaatataatata

SEQ ID NO: 48839 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagataattcacataactc

SEQ ID NO: 48840 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagataattcacataactca

SEQ ID NO: 48841 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agataattcacataactcaa

SEQ ID NO: 48842 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttattaatttatttattttt

SEQ ID NO: 48843 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taatttatttatttttgaga

SEQ ID NO: 48844 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acagtttcgctcttgttgcc

SEQ ID NO: 48845 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cagtttcgctcttgttgccc

SEQ ID NO: 48846 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcgctcttgttgcccaggc

SEQ ID NO: 48847 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cgctcttgttgcccaggctg

SEQ ID NO: 48848 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgcccaggctggagtgcaa

SEQ ID NO: 48849 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ggagtgcaatggcacgatct

SEQ ID NO: 48850 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caccgcaacctctgcctccc

SEQ ID NO: 48851 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacctctgcctcccgagttc

SEQ ID NO: 48852 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcaagcgattctcctgcct

SEQ ID NO: 48853 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttctcctgcctcagcctcct

SEQ ID NO: 48854 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcctgcctcagcctcctgag

SEQ ID NO: 48855 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcctcagcctcctgagtagc

SEQ ID NO: 48856 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcctgagtagctggaatta

SEQ ID NO: 48857 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcctgagtagctggaattac

SEQ ID NO: 48858 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
caggcgcccaccaccatgcc

SEQ ID NO: 48859 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cggctaattttttgtatttt

SEQ ID NO: 48860 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctaattttttgtatttttag

SEQ ID NO: 48861 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aattttttgtatttttagta

SEQ ID NO: 48862 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ttttgtatttttagtagaga

SEQ ID NO: 48863 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttgtatttttagtagagac

SEQ ID NO: 48864 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttgtatttttagtagagacg

SEQ ID NO: 48865 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tctttttttgtattattttt

SEQ ID NO: 48866 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaaaaaaaaaaatacatg

SEQ ID NO: 48867 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaaatacatgaagcaattc

SEQ ID NO: 48868 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atacatgaagcaattccaga

SEQ ID NO: 48869 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattaaattaaatttgatta

SEQ ID NO: 48870 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attaaattaaatttgattaa

SEQ ID NO: 48871 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttaaaggctgtctgtgtaca

SEQ ID NO: 48872 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaggctgtctgtgtacata

SEQ ID NO: 48873 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caaattgcattctaatctat

SEQ ID NO: 48874 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tattagtatattcttgtaac

SEQ ID NO: 48875 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tagtatattcttgtaacaag

SEQ ID NO: 48876 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttgtaacaagtagctgtct

SEQ ID NO: 48877 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtagctgtctcagccaatca

SEQ ID NO: 48878 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gctgtctcagccaatcacag

SEQ ID NO: 48879 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctcagccaatcacagcagct

SEQ ID NO: 48880 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caatcacagcagctgagctt

SEQ ID NO: 48881 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agctgagcttcagccaacca

SEQ ID NO: 48882 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
accacagcctgctgatttat

SEQ ID NO: 48883 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttatcagacaatgtccacat

SEQ ID NO: 48884 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tatcagacaatgtccacata

SEQ ID NO: 48885 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtccacataaggcaaatgtc

SEQ ID NO: 48886 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taaggcaaatgtcaagctat

SEQ ID NO: 48887 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgtcaagctataagcaatc

SEQ ID NO: 48888 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atactcctgctcatgttgct

SEQ ID NO: 48889 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cctgctcatgttgctgagtt

SEQ ID NO: 48890 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgagctctccgaacttctct

SEQ ID NO: 48891 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tccgaacttctcttggttct

SEQ ID NO: 48892 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttattattattatcttattt

SEQ ID NO: 48893 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tactatttcattgctgaaat

SEQ ID NO: 48894 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaaaatttttcttttaaca

SEQ ID NO: 48895 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaaatttttcttttaacaa

SEQ ID NO: 48896 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttttcttttaacaaaggtt

SEQ ID NO: 48897 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaggttaagaaaaccattca

SEQ ID NO: 48898 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaccattcacagtataaact

SEQ ID NO: 48899 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcacagtataaactcagaaa

SEQ ID NO: 48900 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cacagtataaactcagaaat

SEQ ID NO: 48901 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagtataaactcagaaatag

SEQ ID NO: 48902 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataaactcagaaataggagc

SEQ ID NO: 48903 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcagaaataggagcaagact

SEQ ID NO: 48904 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggagcaagactcagaataa

SEQ ID NO: 48905 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggagcaagactcagaataaa

SEQ ID NO: 48906 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caagactcagaataaaagga

SEQ ID NO: 48907 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagaataaaaggacagatcc

SEQ ID NO: 48908 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ataaaaggacagatcccagt

SEQ ID NO: 48909 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agatcccagtgagaaaactt

SEQ ID NO: 48910 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagaaaacttaagtttaaat

SEQ ID NO: 48911 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aacttaagtttaaataagtg

SEQ ID NO: 48912 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taatctacaatattaaatgt

SEQ ID NO: 48913 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attaaatgtaagttactcat

SEQ ID NO: 48914 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catcagatatattaatttta

SEQ ID NO: 48915 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattttacagcatataaatt

SEQ ID NO: 48916 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaataaaattctccatccat

SEQ ID NO: 48917 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attctccatccattggaaat

SEQ ID NO: 48918 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caaatcatgtttgtaacaat

SEQ ID NO: 48919 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtttgtaacaatcagaaac

SEQ ID NO: 48920 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtaacaatcagaaactggaa

SEQ ID NO: 48921 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aacaatcagaaactggaaaa

SEQ ID NO: 48922 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acaatcagaaactggaaaag

SEQ ID NO: 48923 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caatcagaaactggaaaaga

SEQ ID NO: 48924 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaaagagggtaaatataaa

SEQ ID NO: 48925 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagagggtaaatataaaaag

SEQ ID NO: 48926 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agagggtaaatataaaaaga

SEQ ID NO: 48927 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gagggtaaatataaaaagaa

SEQ ID NO: 48928 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agggtaaatataaaaagaag

SEQ ID NO: 48929 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgctaaattcctcatcaaa

SEQ ID NO: 48930 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctaaattcctcatcaaatgg

SEQ ID NO: 48931 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aattcctcatcaaatggtgg

SEQ ID NO: 48932 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acattttacttcaaaacttt

SEQ ID NO: 48933 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaactttcagttttcttgtt

SEQ ID NO: 48934 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aactttcagttttcttgtta

SEQ ID NO: 48935 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttttctgtcattttattta

SEQ ID NO: 48936 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atttatagtcttttaccatg

SEQ ID NO: 48937 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttatagtcttttaccatgt

SEQ ID NO: 48938 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tagtcttttaccatgtgggc

SEQ ID NO: 48939 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtcttttaccatgtgggct

SEQ ID NO: 48940 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttatttgattttatttatca

SEQ ID NO: 48941 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgattttatttatcacagt

SEQ ID NO: 48942 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttttatttatcacagtgagt

SEQ ID NO: 48943 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atttatcacagtgagtgaga

SEQ ID NO: 48944 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttatcacagtgagtgagaa

SEQ ID NO: 48945 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgagtgagaaaggacacatt

SEQ ID NO: 48946 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaggacacatttggtaaaat

SEQ ID NO: 48947 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatattactttttattatct

SEQ ID NO: 48948 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atattactttttattatcta

SEQ ID NO: 48949 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attactttttattatctaag

SEQ ID NO: 48950 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttcctccctcatttccttt

SEQ ID NO: 48951 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccctcatttccttttggcaa

SEQ ID NO: 48952 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcaacagcacatatatttga

SEQ ID NO: 48953 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
caacagcacatatatttgaa

SEQ ID NO: 48954 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgtgacttccataccacacc

SEQ ID NO: 48955 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtgacttccataccacacct

SEQ ID NO: 48956 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cctgggtcaaattatctatt

SEQ ID NO: 48957 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttaagatttatgtattcacg

SEQ ID NO: 48958 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taagatttatgtattcacgt

SEQ ID NO: 48959 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgtattcacgtgggcaccat

SEQ ID NO: 48960 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttcacgtgggcaccatcaga

SEQ ID NO: 48961 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
accatcagatagatacattc

SEQ ID NO: 48962 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccatcagatagatacattcc

SEQ ID NO: 48963 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gatagatacattccaggtgt

SEQ ID NO: 48964 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gatacattccaggtgtcaga

SEQ ID NO: 48965 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cattccaggtgtcagacaga

SEQ ID NO: 48966 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccaatattcatcaaccgttc

SEQ ID NO: 48967 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tattcatcaaccgttccagt

SEQ ID NO: 48968 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttcatcaaccgttccagtga

SEQ ID NO: 48969 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tccagtgagagacaccatgc

SEQ ID NO: 48970 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccagtgagagacaccatgct

SEQ ID NO: 48971 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cagtgagagacaccatgcta

SEQ ID NO: 48972 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
agtgagagacaccatgctag

SEQ ID NO: 48973 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catgctaggggataattgtt

SEQ ID NO: 48974 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgctaggggataattgttta

SEQ ID NO: 48975 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attcaattcatgctttatgt

SEQ ID NO: 48976 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctaattgatacttctgaatt

SEQ ID NO: 48977 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attgatacttctgaattaag

SEQ ID NO: 48978 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctgaattaagcagacttct

SEQ ID NO: 48979 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgaattaagcagacttctga

SEQ ID NO: 48980 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagacttctgagagtgcata

SEQ ID NO: 48981 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgcatacagatgatctcatg

SEQ ID NO: 48982 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgatctcatgtggtaccta

SEQ ID NO: 48983 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaactttgatatcttgccat

SEQ ID NO: 48984 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttgccatcagcctatattg

SEQ ID NO: 48985 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttgccatcagcctatattga

SEQ ID NO: 48986 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccatcagcctatattgaagg

SEQ ID NO: 48987 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgaaggaagccattaaaaa

SEQ ID NO: 48988 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acagctatgaaactcgtcat

SEQ ID NO: 48989 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaactcgtcattggttaca

SEQ ID NO: 48990 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
actcgtcattggttacaaag

SEQ ID NO: 48991 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttacaaagtggatgttgata

SEQ ID NO: 48992 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagtggatgttgataaagct

SEQ ID NO: 48993 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttttgctttgtacaaatctt

SEQ ID NO: 48994 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tttgctttgtacaaatcttt

SEQ ID NO: 48995 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatctttaggaatactatc

SEQ ID NO: 48996 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttaggaatactatcaagata

SEQ ID NO: 48997 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttatcattatatatgattaa

SEQ ID NO: 48998 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatatgattaatagaacttt

SEQ ID NO: 48999 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatagaactttaagatgtta

SEQ ID NO: 49000 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctttaagatgttatagttat

SEQ ID NO: 49001 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agttatgagtacaatctatt

SEQ ID NO: 49002 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acattatatataataaatat

SEQ ID NO: 49003 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tattatattgttaaatgtaa

SEQ ID NO: 49004 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atggttaatgttattaattc

SEQ ID NO: 49005 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggttaatgttattaattca

SEQ ID NO: 49006 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caaggctacatttatttctc

SEQ ID NO: 49007 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aggctacatttatttctcta

SEQ ID NO: 49008 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aataattcttttttatgata

SEQ ID NO: 49009 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttttttatgatatagaaat

SEQ ID NO: 49010 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttttttatgatatagaaatt

SEQ ID NO: 49011 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gatatagaaattaggaatta

SEQ ID NO: 49012 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctatcctgtgttccttttgc

SEQ ID NO: 49013 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttccttttgccagtactgc

SEQ ID NO: 49014 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttttgccagtactgctaga

SEQ ID NO: 49015 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gccagtactgctagatagct

SEQ ID NO: 49016 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
actgctagatagcttagaac

SEQ ID NO: 49017 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctgctagatagcttagaacc

SEQ ID NO: 49018 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
catgacccaaattcacactg

SEQ ID NO: 49019 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gacccaaattcacactgtag

SEQ ID NO: 49020 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cagctttctatatatttgaa

SEQ ID NO: 49021 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctttgaaatgattaaaatga

SEQ ID NO: 49022 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagcaacatttcattattaa

SEQ ID NO: 49023 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcaacatttcattattaaaa

SEQ ID NO: 49024 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aacatttcattattaaaaga

SEQ ID NO: 49025 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttaaaagagagcaatgtttt

SEQ ID NO: 49026 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcaacctaataacaaatgc

SEQ ID NO: 49027 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcaacctaataacaaatgca

SEQ ID NO: 49028 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaggacattcttacttcta

SEQ ID NO: 49029 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctaaagtcttcttcactctc

SEQ ID NO: 49030 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taaagtcttcttcactctct

SEQ ID NO: 49031 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaagtcttcttcactctcta

SEQ ID NO: 49032 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctaatgtttcattattttc

SEQ ID NO: 49033 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttcgaaaacatttatgctt

SEQ ID NO: 49034 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttcgaaaacatttatgcttc

SEQ ID NO: 49035 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgcttcaggtttcccatgaa

SEQ ID NO: 49036 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aggtttcccatgaacagctg

SEQ ID NO: 49037 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgaacagctgtagtccaat

SEQ ID NO: 49038 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccaattagtgcaaacacact

SEQ ID NO: 49039 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttagtgcaaacacactcaga

SEQ ID NO: 49040 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaacacactcagacagaaca

SEQ ID NO: 49041 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acactcagacagaacacagt

SEQ ID NO: 49042 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cactcagacagaacacagtc

SEQ ID NO: 49043 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cacagtcaggatcatgacat

SEQ ID NO: 49044 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtcaggatcatgacatcaga

SEQ ID NO: 49045 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cagaaagcttcttcactgac

SEQ ID NO: 49046 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttcttcactgactggatca

SEQ ID NO: 49047 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaagcccctacaattgtctt

SEQ ID NO: 49048 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagcccctacaattgtcttc

SEQ ID NO: 49049 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attgtcttcaggcctgaaaa

SEQ ID NO: 49050 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttgtcttcaggcctgaaaat

SEQ ID NO: 49051 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtcttcaggcctgaaaatgg

SEQ ID NO: 49052 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggcctgaaaatgggagaaaa

SEQ ID NO: 49053 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagtgtttgtaatgacata

SEQ ID NO: 49054 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaatcgaaacaaaaaacac

SEQ ID NO: 49055 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acaaaaaacacaagctttcc

SEQ ID NO: 49056 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaacacaagctttcctaga

SEQ ID NO: 49057 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tatatcaaatcaatgacctt

SEQ ID NO: 49058 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taagtaacctaattcaaaaa

SEQ ID NO: 49059 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctaattcaaaaaaagccttc

SEQ ID NO: 49060 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taattcaaaaaaagccttct

SEQ ID NO: 49061 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tactttgtttttatatatta

SEQ ID NO: 49062 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttttatatattacagcaaa

SEQ ID NO: 49063 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttacagcaaatggttaaaaa

SEQ ID NO: 49064 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tacagcaaatggttaaaaat

SEQ ID NO: 49065 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaataggaacatattctca

SEQ ID NO: 49066 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acatattctcaaagaatacc

SEQ ID NO: 49067 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catattctcaaagaatacct

SEQ ID NO: 49068 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggttgtcaaaatgaacaatt

SEQ ID NO: 49069 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actttaaaaataatttttgt

SEQ ID NO: 49070 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acaaaccacttctctataaa

SEQ ID NO: 49071 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aatggcaccaaaacaaatta

SEQ ID NO: 49072 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccaaaacaaattacagcata

SEQ ID NO: 49073 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccttgtaataattttcaata

SEQ ID NO: 49074 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aataattttcaataaagaaa

SEQ ID NO: 49075 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caataaagaaatggtttgct

SEQ ID NO: 49076 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatttatgatctctttcct

SEQ ID NO: 49077 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tattttaaaatcaattaaaa

SEQ ID NO: 49078 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaaattttccttcctgtat

SEQ ID NO: 49079 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttccttcctgtataagcaaa

SEQ ID NO: 49080 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caaatggaaaaacaaaccct

SEQ ID NO: 49081 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tggaaaaacaaaccctcaga

SEQ ID NO: 49082 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggaaaaacaaaccctcagac

SEQ ID NO: 49083 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaaacaaaccctcagacag

SEQ ID NO: 49084 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaacaaaccctcagacagg

SEQ ID NO: 49085 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aaacaaaccctcagacagga

SEQ ID NO: 49086 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaaccctcagacaggaggg

SEQ ID NO: 49087 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagacaggagggaagatttc

SEQ ID NO: 49088 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aggagggaagatttcaagtt

SEQ ID NO: 49089 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aagatttcaagttgagatgt

SEQ ID NO: 49090 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttcaagttgagatgtgagcc

SEQ ID NO: 49091 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aagttgagatgtgagccaag

SEQ ID NO: 49092 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagtagtcatcctcatccta

SEQ ID NO: 49093 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catgcaattgattaaactca

SEQ ID NO: 49094 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atgcaattgattaaactcaa

SEQ ID NO: 49095 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgacttttgataatgattg

SEQ ID NO: 49096 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttgataatgattgtggaaaa

SEQ ID NO: 49097 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ataatgattgtggaaaacag

SEQ ID NO: 49098 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatttaattaaaattgcata

SEQ ID NO: 49099 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taattaaaattgcataaaga

SEQ ID NO: 49100 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aattaaaattgcataaagaa

SEQ ID NO: 49101 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttttatgtctttctttcaa

SEQ ID NO: 49102 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtctttctttcaaaagatca

SEQ ID NO: 49103 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttctttcaaaagatcaaagt

SEQ ID NO: 49104 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caaaagatcaaagtcagccc

SEQ ID NO: 49105 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgtttaaccccactctcacc

SEQ ID NO: 49106 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ctgaaattgttttcaatgct

SEQ ID NO: 49107 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaaattgttttcaatgctcg

SEQ ID NO: 49108 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctctgaatgttctcaatgct

SEQ ID NO: 49109 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctcaatgctgagacattgcc

SEQ ID NO: 49110 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcaatgctgagacattgccc

SEQ ID NO: 49111 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
actctgtcacatatctgtaa

SEQ ID NO: 49112 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctctgtcacatatctgtaat

SEQ ID NO: 49113 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tctgtcacatatctgtaata

SEQ ID NO: 49114 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ctgtcacatatctgtaatag

SEQ ID NO: 49115 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtcacatatctgtaataggg

SEQ ID NO: 49116 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aataggggagtttatacaca

SEQ ID NO: 49117 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gacacacacacaaacgaaca

SEQ ID NO: 49118 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aacaaagaacaactcccaaa

SEQ ID NO: 49119 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagaacaactcccaaatagt

SEQ ID NO: 49120 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaacaactcccaaatagttg

SEQ ID NO: 49121 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcccaaatagttggagttat

SEQ ID NO: 49122 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caaatagttggagttatgag

SEQ ID NO: 49123 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cacaccaattacttcttacc

SEQ ID NO: 49124 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
acaccaattacttcttacct

SEQ ID NO: 49125 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttacttcttacctgggatta

SEQ ID NO: 49126 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cttacctgggattacagaaa

SEQ ID NO: 49127 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gattacagaaatagttttca

SEQ ID NO: 49128 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaagctctcaatactctga

SEQ ID NO: 49129 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctcaatactctgaaagttcg

SEQ ID NO: 49130 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caatactctgaaagttcgaa

SEQ ID NO: 49131 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cgaagagctgaaacattgcc

SEQ ID NO: 49132 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaagagctgaaacattgcct

SEQ ID NO: 49133 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caaattctgttaaatacctg

SEQ ID NO: 49134 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaatacctgtagaattaaat

SEQ ID NO: 49135 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agaattaaatcagaattatt

SEQ ID NO: 49136 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatcagaattattcagaatt

SEQ ID NO: 49137 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agaattattcagaatttaga

SEQ ID NO: 49138 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aattattcagaatttagata

SEQ ID NO: 49139 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agagtctatgatacttacct

SEQ ID NO: 49140 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atgatacttacctgagcctt

SEQ ID NO: 49141 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acttacctgagcctttagtc

SEQ ID NO: 49142 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttacctgagcctttagtca

SEQ ID NO: 49143 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtcaaggtattttctacgtt

SEQ ID NO: 49144 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tcaaggtattttctacgttt

SEQ ID NO: 49145 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caaggtattttctacgtttg

SEQ ID NO: 49146 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gggcttctattttaaatgta

SEQ ID NO: 49147 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttaaatgtatagttctgc

SEQ ID NO: 49148 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cataactaacttaatttaat

SEQ ID NO: 49149 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
catttgatgcaaacaaaata

SEQ ID NO: 49150 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gatattatatattattaaat

SEQ ID NO: 49151 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
caactaaatgtttcaattgt

SEQ ID NO: 49152 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgttggacccttaacatta

SEQ ID NO: 49153 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cccttaacattatggtaatt

SEQ ID NO: 49154 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttttataaaacattgaaaa

SEQ ID NO: 49155 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacattgaaaatagtatgct

SEQ ID NO: 49156 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaaaatagtatgctaagtgt

SEQ ID NO: 49157 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgctaagtgtcagacacaa

SEQ ID NO: 49158 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgctaagtgtcagacacaaa

SEQ ID NO: 49159 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cattcataaaaaaatccaaa

SEQ ID NO: 49160 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatccaaatagacaaatcca

SEQ ID NO: 49161 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tccaaatagacaaatccata

SEQ ID NO: 49162 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatccatagagataaaaca

SEQ ID NO: 49163 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
catagagataaaacatagat

SEQ ID NO: 49164 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agagataaaacatagatgag

SEQ ID NO: 49165 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacatagatgagtggtttcc

SEQ ID NO: 49166 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acatagatgagtggtttcca

SEQ ID NO: 49167 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
catagatgagtggtttccaa

SEQ ID NO: 49168 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
atagatgagtggtttccaag

SEQ ID NO: 49169 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgagtggtttccaaggggc

SEQ ID NO: 49170 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgagtggtttccaaggggcc

SEQ ID NO: 49171 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gagtggtttccaaggggcca

SEQ ID NO: 49172 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtggtttccaaggggccagg

SEQ ID NO: 49173 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggtttccaaggggccaggga

SEQ ID NO: 49174 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttccaaggggccagggagag

SEQ ID NO: 49175 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tccaaggggccagggagaga

SEQ ID NO: 49176 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccagggagagaaggaaattg

SEQ ID NO: 49177 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaattgaagtgactgctaat

SEQ ID NO: 49178 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaagtgactgctaatgagta

SEQ ID NO: 49179 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtgactgctaatgagtaca

SEQ ID NO: 49180 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgagtacagagtttctatt

SEQ ID NO: 49181 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tgagtacagagtttctattt

SEQ ID NO: 49182 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gagtacagagtttctatttg

SEQ ID NO: 49183 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggttgttaaacttctctaat

SEQ ID NO: 49184 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gttgttaaacttctctaatt

SEQ ID NO: 49185 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gttaaacttctctaattagg

SEQ ID NO: 49186 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaacttctctaattaggtag

SEQ ID NO: 49187 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aggtagtggtgatgttgcgc

SEQ ID NO: 49188 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctttaaaattgtgaattttg

SEQ ID NO: 49189 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tagtatttgaattgtaccaa

SEQ ID NO: 49190 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtatttgaattgtaccaat

SEQ ID NO: 49191 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aattgtaccaataggaaaaa

SEQ ID NO: 49192 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attgtaccaataggaaaaaa

SEQ ID NO: 49193 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtaccaataggaaaaaaag

SEQ ID NO: 49194 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aggaaaaaaaggagacctat

SEQ ID NO: 49195 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaaaaggagacctatgag

SEQ ID NO: 49196 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaaaggagacctatgagaa

SEQ ID NO: 49197 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaaggagacctatgagaag

SEQ ID NO: 49198 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aggagacctatgagaagagg

SEQ ID NO: 49199 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttctttgcacaatgttttct

SEQ ID NO: 49200 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tttgcacaatgttttcttag

SEQ ID NO: 49201 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcacaatgttttcttagcag

SEQ ID NO: 49202 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cacaatgttttcttagcagc

SEQ ID NO: 49203 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatgttttcttagcagcagg

SEQ ID NO: 49204 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttttcttagcagcaggtag

SEQ ID NO: 49205 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcttagcagcaggtagcaga

SEQ ID NO: 49206 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cccatcatatgtgacctcaa

SEQ ID NO: 49207 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccatcatatgtgacctcaaa

SEQ ID NO: 49208 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atcatatgtgacctcaaaag

SEQ ID NO: 49209 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcatatgtgacctcaaaagg

SEQ ID NO: 49210 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
catatgtgacctcaaaagga

SEQ ID NO: 49211 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatgtgacctcaaaaggagg

SEQ ID NO: 49212 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctcaaaaggagggagcctga

SEQ ID NO: 49213 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaggagggagcctgatggaa

SEQ ID NO: 49214 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggagggagcctgatggaaaa

SEQ ID NO: 49215 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gagggagcctgatggaaaag

SEQ ID NO: 49216 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gagcctgatggaaaagaggt

SEQ ID NO: 49217 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agcctgatggaaaagaggtt

SEQ ID NO: 49218 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgatggaaaagaggttagg

SEQ ID NO: 49219 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgatggaaaagaggttaggc

SEQ ID NO: 49220 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gatggaaaagaggttaggca

SEQ ID NO: 49221 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaagaggttaggcagggatg

SEQ ID NO: 49222 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagaggttaggcagggatga

SEQ ID NO: 49223 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
ttaggcagggatgaaggaat

SEQ ID NO: 49224 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gggatgaaggaatcggatat

SEQ ID NO: 49225 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggatgaaggaatcggatatt

SEQ ID NO: 49226 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aatcggatattaggaatctt

SEQ ID NO: 49227 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taagacccttctgtattgtc

SEQ ID NO: 49228 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagacccttctgtattgtct

SEQ ID NO: 49229 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acccttctgtattgtctagg

SEQ ID NO: 49230 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgtattgtctaggtggctc

SEQ ID NO: 49231 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ctaggtggctccagtgaacc

SEQ ID NO: 49232 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tggattactttgataattca

SEQ ID NO: 49233 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tgataattcaaagtcattaa

SEQ ID NO: 49234 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tcaaagtcattaacggaaaa

SEQ ID NO: 49235 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttaacggaaaatagaatatc

SEQ ID NO: 49236 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaaatagaatatctagatat

SEQ ID NO: 49237 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atttttctgataaatacatt

SEQ ID NO: 49238 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tttttctgataaatacattt

SEQ ID NO: 49239 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctgataaatacatttgggaa

SEQ ID NO: 49240 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gataaatacatttgggaaaa

SEQ ID NO: 49241 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attttccttgaaaataaact

SEQ ID NO: 49242 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgtatacaatgcattaatct

SEQ ID NO: 49243 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtatacaatgcattaatctt

SEQ ID NO: 49244 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
caatgcattaatcttaggct

SEQ ID NO: 49245 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcattaatcttaggcttagt

SEQ ID NO: 49246 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttaatcttaggcttagtaag

SEQ ID NO: 49247 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttaggcttagtaagcagtga

SEQ ID NO: 49248 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tataaaataattgaataata

SEQ ID NO: 49249 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ataaaataattgaataatac

SEQ ID NO: 49250 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
taaaataattgaataataca

SEQ ID NO: 49251 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaataatacagggtaatata

SEQ ID NO: 49252 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ataatacagggtaatataaa

SEQ ID NO: 49253 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gagcactgtacttgtattta

SEQ ID NO: 49254 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agcactgtacttgtatttaa

SEQ ID NO: 49255 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtacttgtatttaaaggcct

SEQ ID NO: 49256 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agttttttgtgtgcttctta

SEQ ID NO: 49257 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gttttttgtgtgcttcttat

SEQ ID NO: 49258 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggttttattcatttttaaac

SEQ ID NO: 49259 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcatttttaaacaagaact

SEQ ID NO: 49260 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttaaacaagaacttggaaa

SEQ ID NO: 49261 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggaaaaagtgtaaacctaat

SEQ ID NO: 49262 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taaacctaattggcactgca

SEQ ID NO: 49263 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actgcatagactatccatcc

SEQ ID NO: 49264 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agactatccatccaagtgct

SEQ ID NO: 49265 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atccatccaagtgctgagca

SEQ ID NO: 49266 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccatccaagtgctgagcatg

SEQ ID NO: 49267 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catccaagtgctgagcatgg

SEQ ID NO: 49268 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccaagtgctgagcatggagg

SEQ ID NO: 49269 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
caatgatgtcacatacctct

SEQ ID NO: 49270 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgatgtcacatacctctgag

SEQ ID NO: 49271 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gatgtcacatacctctgagt

SEQ ID NO: 49272 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tgtcacatacctctgagtgg

SEQ ID NO: 49273 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acatacctctgagtgggaga

SEQ ID NO: 49274 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gatagtctttttgaaaaatt

SEQ ID NO: 49275 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtatttgcctatcaatgac

SEQ ID NO: 49276 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atcaatgactagctttcata

SEQ ID NO: 49277 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttccattttcctttaaata

SEQ ID NO: 49278 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taaatacagacattccatgc

SEQ ID NO: 49279 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
acattccatgctggaaaaat

SEQ ID NO: 49280 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgctggaaaaatcagaccc

SEQ ID NO: 49281 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gctggaaaaatcagacccca

SEQ ID NO: 49282 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctggaaaaatcagaccccag

SEQ ID NO: 49283 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccccagaggtttgctgttat

SEQ ID NO: 49284 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
attggaacactgtgctgcct

SEQ ID NO: 49285 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cataaatttgccgtttcaaa

SEQ ID NO: 49286 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgccgtttcaaaaagctga

SEQ ID NO: 49287 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaaacaatgacgacaaaatc

SEQ ID NO: 49288 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caatgacgacaaaatccagc

SEQ ID NO: 49289 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
acaaaatccagccagttcca

SEQ ID NO: 49290 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
caaaatccagccagttccac

SEQ ID NO: 49291 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agccagttccacgggtcacg

SEQ ID NO: 49292 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gttccacgggtcacgaagaa

SEQ ID NO: 49293 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaaaagtgaattctcctaca

SEQ ID NO: 49294 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagtgaattctcctacacag

SEQ ID NO: 49295 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cctacacagaagcctcttgc

SEQ ID NO: 49296 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctacacagaagcctcttgca

SEQ ID NO: 49297 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cctcttgcaaggatttttac

SEQ ID NO: 49298 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gatttttacaagtgattcaa

SEQ ID NO: 49299 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgattcaaaagtatatattc

SEQ ID NO: 49300 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaagtatatattccagtaa

SEQ ID NO: 49301 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtaaaagtgtacctaaacac

SEQ ID NO: 49302 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acctaaacacaagattccat

SEQ ID NO: 49303 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
cctaaacacaagattccatt

SEQ ID NO: 49304 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acaagattccattgggatac

SEQ ID NO: 49305 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
attgggatactagatgtgaa

SEQ ID NO: 49306 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tattttctctaattaaccac

SEQ ID NO: 49307 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tttctctaattaaccactgg

SEQ ID NO: 49308 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aaccactggaagacatatat

SEQ ID NO: 49309 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccactggaagacatatattg

SEQ ID NO: 49310 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cactggaagacatatattgg

SEQ ID NO: 49311 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggaagacatatattggagga

SEQ ID NO: 49312 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atatattggaggatggctgt

SEQ ID NO: 49313 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
tatattggaggatggctgtt

SEQ ID NO: 49314 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggaggatggctgttgggtta

SEQ ID NO: 49315 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cacaccctattaaactacaa

SEQ ID NO: 49316 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
acaccctattaaactacaat

SEQ ID NO: 49317 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaactacaataggtctatc

SEQ ID NO: 49318 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaatattaaaatgtcaatat

SEQ ID NO: 49319 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtcaatatcagaaacactcc

SEQ ID NO: 49320 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atatcagaaacactcccaga

SEQ ID NO: 49321 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcagaaacactcccagaaag

SEQ ID NO: 49322 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agaaacactcccagaaagca

SEQ ID NO: 49323 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gaaacactcccagaaagcag

SEQ ID NO: 49324 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagaggtacttgaaataact

SEQ ID NO: 49325 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acttgaaataactaagaata

SEQ ID NO: 49326 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttgaaataactaagaatat

SEQ ID NO: 49327 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ataactaagaatataggtct

SEQ ID NO: 49328 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
taattataaaacatacaccc

SEQ ID NO: 49329 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaatatgtgtaacatgtct

SEQ ID NO: 49330 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atgtgtaacatgtctaagaa

SEQ ID NO: 49331 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgtgtaacatgtctaagaac

SEQ ID NO: 49332 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
taacatgtctaagaacagga

SEQ ID NO: 49333 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
acatgtctaagaacaggatg

SEQ ID NO: 49334 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacaggatggagcatctgac

SEQ ID NO: 49335 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
atctgacaagttcattcttt

SEQ ID NO: 49336 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
cattctttgagaaaacactg

SEQ ID NO: 49337 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agcatctaatttttctaatc

SEQ ID NO: 49338 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atctaatttttctaatctag

SEQ ID NO: 49339 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tctaatttttctaatctagc

SEQ ID NO: 49340 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatctagcaggttaatatca

SEQ ID NO: 49341 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctagcaggttaatatcata

SEQ ID NO: 49342 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ctagcaggttaatatcatag

SEQ ID NO: 49343 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agcaggttaatatcatagag

SEQ ID NO: 49344 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gcaggttaatatcatagagg

SEQ ID NO: 49345 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaatatcatagaggaggta

SEQ ID NO: 49346 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atagaggaggtaaagaacaa

SEQ ID NO: 49347 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ggaggtaaagaacaaaagaa

SEQ ID NO: 49348 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtaaagaacaaaagaaaagc

SEQ ID NO: 49349 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agaaaagcaagcatataaca

SEQ ID NO: 49350 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gaaaagcaagcatataacat

SEQ ID NO: 49351 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aagcaagcatataacatggg

SEQ ID NO: 49352 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agcaagcatataacatggga

SEQ ID NO: 49353 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcatataacatgggaaggta

SEQ ID NO: 49354 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
attccccatcttcataaatg

SEQ ID NO: 49355 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tcataaatgcagtaacttcc

SEQ ID NO: 49356 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaatgcagtaacttcctgg

SEQ ID NO: 49357 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaatgcagtaacttcctggc

SEQ ID NO: 49358 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagtaacttcctggcaggaa

SEQ ID NO: 49359 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agtaacttcctggcaggaaa

SEQ ID NO: 49360 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acttcctggcaggaaaagga

SEQ ID NO: 49361 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttcctggcaggaaaaggaa

SEQ ID NO: 49362 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acccacttactcgacatttt

SEQ ID NO: 49363 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cttactcgacatttttggtc

SEQ ID NO: 49364 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tcgacatttttggtccagtc

SEQ ID NO: 49365 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
acatttttggtccagtccgg

SEQ ID NO: 49366 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
catttttggtccagtccggt

SEQ ID NO: 49367 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ccagtccggtgggttattca

SEQ ID NO: 49368 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tattcatggtcataaatatg

SEQ ID NO: 49369 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gtcataaatatgcagtttgt

SEQ ID NO: 49370 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaatatgcagtttgtcagaa

SEQ ID NO: 49371 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtcagaatagtgcacatgat

SEQ ID NO: 49372 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
acatgatgagcatgctgaat

SEQ ID NO: 49373 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catgatgagcatgctgaata

SEQ ID NO: 49374 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gatgagcatgctgaataagg

SEQ ID NO: 49375 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
gcatgctgaataaggtagct

SEQ ID NO: 49376 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaataaggtagcttagaatc

SEQ ID NO: 49377 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aataaggtagcttagaatca

SEQ ID NO: 49378 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agcttagaatcaaggaacaa

SEQ ID NO: 49379 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cttagaatcaaggaacaaaa

SEQ ID NO: 49380 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcaaggaacaaaagagacga

SEQ ID NO: 49381 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aggaacaaaagagacgacag

SEQ ID NO: 49382 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ggaacaaaagagacgacagt

SEQ ID NO: 49383 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtgggaatttgaaatattt

SEQ ID NO: 49384 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtgggaatttgaaatatttg

SEQ ID NO: 49385 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaatgcttacaacttttcct

SEQ ID NO: 49386 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctaagaaaaaaattctaaat

SEQ ID NO: 49387 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aaaaattctaaatgagcttg

SEQ ID NO: 49388 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actattttgtctctttgaac

SEQ ID NO: 49389 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tattttgtctctttgaacaa

SEQ ID NO: 49390 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttttgtctctttgaacaaga

SEQ ID NO: 49391 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aacaagagagtaataaataa

SEQ ID NO: 49392 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcttaatattgccactctcc

SEQ ID NO: 49393 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ccactctcccagtcttctct

SEQ ID NO: 49394 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tgaaattaataaactaaaac

SEQ ID NO: 49395 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aaattaataaactaaaacca

SEQ ID NO: 49396 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aactaaaaccagagtctttc

SEQ ID NO: 49397 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
actaaaaccagagtctttca

SEQ ID NO: 49398 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagagtctttcaaggtgcaa

SEQ ID NO: 49399 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
agagtctttcaaggtgcaaa

SEQ ID NO: 49400 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acatctatatttgaataaaa

SEQ ID NO: 49401 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atagcaaaaattacaccata

SEQ ID NO: 49402 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attacaccataaagtgccac

SEQ ID NO: 49403 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ctggatgtaatcatttttaa

SEQ ID NO: 49404 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tggatgtaatcatttttaaa

SEQ ID NO: 49405 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatcatttttaaaaggatat

SEQ ID NO: 49406 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgagtgtactaaaatcttaa

SEQ ID NO: 49407 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atcttaatagatattcttct

SEQ ID NO: 49408 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cttaatagatattcttctta

SEQ ID NO: 49409 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ttaatagatattcttcttag

SEQ ID NO: 49410 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tattcttcttagaggactga

SEQ ID NO: 49411 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
attcttcttagaggactgaa

SEQ ID NO: 49412 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcttcttagaggactgaaag

SEQ ID NO: 49413 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttagaggactgaaaggaga

SEQ ID NO: 49414 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gaaaggagaaagcatatata

SEQ ID NO: 49415 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aggagaaagcatatataaag

SEQ ID NO: 49416 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ggagaaagcatatataaagc

SEQ ID NO: 49417 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
aagcatatataaagcaggtg

SEQ ID NO: 49418 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aagcaggtgtggcattgaaa

SEQ ID NO: 49419 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caggtgtggcattgaaacgg

SEQ ID NO: 49420 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ccctttgttcaatactatga

SEQ ID NO: 49421 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcaatactatgaaagtctg

SEQ ID NO: 49422 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tcaatactatgaaagtctgc

SEQ ID NO: 49423 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
aatactatgaaagtctgcag

SEQ ID NO: 49424 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
atactatgaaagtctgcagg

SEQ ID NO: 49425 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaaagtctgcaggaggaaa

SEQ ID NO: 49426 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agtctgcaggaggaaaaaga

SEQ ID NO: 49427 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
gtctgcaggaggaaaaagaa

SEQ ID NO: 49428 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaaaaagaaaggatgaaatt

SEQ ID NO: 49429 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tcaatttttcacatcaatat

SEQ ID NO: 49430 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atttttcacatcaatatcag

SEQ ID NO: 49431 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cagcagtttacctttctaca

SEQ ID NO: 49432 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cagtttacctttctacatgg

SEQ ID NO: 49433 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tacatggcagtgttatattg

SEQ ID NO: 49434 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tattgaagaaacactgccat

SEQ ID NO: 49435 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaaacactgccatcagactc

SEQ ID NO: 49436 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gccatcagactccagcaatg

SEQ ID NO: 49437 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cgcatctatcaatgtcacct

SEQ ID NO: 49438 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caccttggccaatgaactcc

SEQ ID NO: 49439 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
actccaagtccacttcttca

SEQ ID NO: 49440 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tcatagtaactttaaaaatt

SEQ ID NO: 49441 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttaaaaattgagctatttgt

SEQ ID NO: 49442 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
atttgttagcatgtattgct

SEQ ID NO: 49443 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttgttagcatgtattgctta

SEQ ID NO: 49444 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
tatttttcattttctttcac

SEQ ID NO: 49445 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttcaccagtaacaataactg

SEQ ID NO: 49446 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cagtaacaataactgtggtt

SEQ ID NO: 49447 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
actgtggttaagttatttta

SEQ ID NO: 49448 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cttccattacactgcatttt

SEQ ID NO: 49449 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
cattacactgcattttaaga

SEQ ID NO: 49450 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgcattttaagaaagccaaa

SEQ ID NO: 49451 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
taagaaagccaaatagaaac

SEQ ID NO: 49452 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tatttttatcataaaacctt

SEQ ID NO: 49453 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ttgagaattttaatacttgc

SEQ ID NO: 49454 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atacttgctggcaattgtta

SEQ ID NO: 49455 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ttgctggcaattgttatggt

SEQ ID NO: 49456 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctggcaattgttatggttag

SEQ ID NO: 49457 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cagcacatgttccaaaatat

SEQ ID NO: 49458 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atttcaaaaaatattttcct

SEQ ID NO: 49459 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaaatattttcctaagttg

SEQ ID NO: 49460 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aaaatattttcctaagttga

SEQ ID NO: 49461 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttcctaagttgaaggaacgt

SEQ ID NO: 49462 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cctaagttgaaggaacgtca

SEQ ID NO: 49463 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
agttgaaggaacgtcagagt

SEQ ID NO: 49464 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgaaggaacgtcagagttgg

SEQ ID NO: 49465 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gaagaatccttccaatcact

SEQ ID NO: 49466 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tgagttcaatttctttattt

SEQ ID NO: 49467 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tttagttataatactaatat

SEQ ID NO: 49468 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atactaatattagcttttaa

SEQ ID NO: 49469 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tactaatattagcttttaaa

SEQ ID NO: 49470 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
actaatattagcttttaaaa

SEQ ID NO: 49471 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttttaaaagggacttaaatt

SEQ ID NO: 49472 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ttaaaagggacttaaattaa

SEQ ID NO: 49473 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taaaagggacttaaattaag

SEQ ID NO: 49474 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
gattcctcacttactaacca

SEQ ID NO: 49475 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
aatttaaaaaacgatatgaa

SEQ ID NO: 49476 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttaaaaaacgatatgaatag

SEQ ID NO: 49477 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
acattcttgaaatgttattg

SEQ ID NO: 49478 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tgttattgtagccattccat

SEQ ID NO: 49479 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
tccataagtgtccttttcca

SEQ ID NO: 49480 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agtgtccttttccatagctt

SEQ ID NO: 49481 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ttttccatagctttagtatt

SEQ ID NO: 49482 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
catagctttagtattcagtt

SEQ ID NO: 49483 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
agttaagaaataaaaacaac

SEQ ID NO: 49484 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taagaaataaaaacaaccag

SEQ ID NO: 49485 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcagtaacaacaaaatatta

SEQ ID NO: 49486 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caaaatattaaagcaaccta

SEQ ID NO: 49487 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attaaagcaacctaaagcat

SEQ ID NO: 49488 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
agcaacctaaagcattggct

SEQ ID NO: 49489 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaagcattggcttagaaat

SEQ ID NO: 49490 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcattggcttagaaatcaga

SEQ ID NO: 49491 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gcttagaaatcagaaagaca

SEQ ID NO: 49492 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaaagacaaagttcaaatcc

SEQ ID NO: 49493 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
atcccagccttatttttctc

SEQ ID NO: 49494 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cagccttatttttctccggt

SEQ ID NO: 49495 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ccttatttttctccggttgg

SEQ ID NO: 49496 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
cttatttttctccggttggc

SEQ ID NO: 49497 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atttttctccggttggcagg

SEQ ID NO: 49498 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ggcaggaagatgacttgtgt

SEQ ID NO: 49499 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
agatgacttgtgttagctga

SEQ ID NO: 49500 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctgactttctaaattttata

SEQ ID NO: 49501 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
tgactttctaaattttatat

SEQ ID NO: 49502 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gactttctaaattttatata

SEQ ID NO: 49503 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taaattttatatagggttat

SEQ ID NO: 49504 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
attttatatagggttatcag

SEQ ID NO: 49505 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttttatatagggttatcagt

SEQ ID NO: 49506 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tagggttatcagtgggtttc

SEQ ID NO: 49507 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atcagtgggtttctggcaat

SEQ ID NO: 49508 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
taagcatttctcaccgtatt

SEQ ID NO: 49509 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aagcatttctcaccgtattc

SEQ ID NO: 49510 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gcatttctcaccgtattcag

SEQ ID NO: 49511 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
catttctcaccgtattcagg

SEQ ID NO: 49512 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tctcaccgtattcaggaggt

SEQ ID NO: 49513 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tattcaggaggtaagtctgt

SEQ ID NO: 49514 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
caggaggtaagtctgtgagt

SEQ ID NO: 49515 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aggaggtaagtctgtgagtc

SEQ ID NO: 49516 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
tcaggctttttatttgtatg

SEQ ID NO: 49517 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ggctttttatttgtatgcgg

SEQ ID NO: 49518 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
gtatgcggcagcgttccctc

SEQ ID NO: 49519 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gttccctcaagaaaacaaat

SEQ ID NO: 49520 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tccctcaagaaaacaaatca

SEQ ID NO: 49521 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
aaatcagagtctattgtttt

SEQ ID NO: 49522 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aatcagagtctattgttttc

SEQ ID NO: 49523 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
cctgctccctttcactgtat

SEQ ID NO: 49524 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
atgtaaaattcacttttaca

SEQ ID NO: 49525 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
attattttaaaattaatacc

SEQ ID NO: 49526 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
aaaattaatacctagtcctc

SEQ ID NO: 49527 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
atcctttttgtcttaaatct

SEQ ID NO: 49528 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ctttttgtcttaaatctcag

SEQ ID NO: 49529 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tttctgcaattgtattgaca

SEQ ID NO: 49530 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gcaattgtattgacatggtt

SEQ ID NO: 49531 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gaattgtaatccccacgtct

SEQ ID NO: 49532 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
aattgtaatccccacgtctc

SEQ ID NO: 49533 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
attgtaatccccacgtctca

SEQ ID NO: 49534 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
ttgtaatccccacgtctcag

SEQ ID NO: 49535 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtaatccccacgtctcaggg

SEQ ID NO: 49536 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
taatccccacgtctcagggg

SEQ ID NO: 49537 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
aatccccacgtctcagggga

SEQ ID NO: 49538 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
cacgtctcaggggagggacc

SEQ ID NO: 49539 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gtctcaggggagggacctgg

SEQ ID NO: 49540 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
caggggagggacctggtggt

SEQ ID NO: 49541 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
gggacctggtggtaagtgat

SEQ ID NO: 49542 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
ggtggtaagtgattggatca

SEQ ID NO: 49543 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gtggtaagtgattggatcat

SEQ ID NO: 49544 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ggtaagtgattggatcatgg

SEQ ID NO: 49545 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
aagtgattggatcatgggag

SEQ ID NO: 49546 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gatcatgggagcggtttccc

SEQ ID NO: 49547 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TAG
ccccagtgctgttctcatga

SEQ ID NO: 49548 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
agtgctgttctcatgatagt

SEQ ID NO: 49549 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
ctgttctcatgatagtgagt

SEQ ID NO: 49550 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
tctcatgatagtgagtgagt

SEQ ID NO: 49551 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
gtgagtgagtgagttctcat

SEQ ID NO: 49552 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: TGG
tgagttctcatgagatctga

SEQ ID NO: 49553 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GGG
gagttctcatgagatctgat

SEQ ID NO: 49554 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
atgagatctgatgggtttaa

SEQ ID NO: 49555 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CGG
atctgatgggtttaaaagtg

SEQ ID NO: 49556 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
tccctctcctgcaccatgtt

SEQ ID NO: 49557 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AAG
ttgccttcgaccatgattgt

SEQ ID NO: 49558 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
accatgattgtaagttttct

SEQ ID NO: 49559 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: AGG
ccatgattgtaagttttctg

SEQ ID NO: 49560 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
ctgaggcctcccctgccatt

SEQ ID NO: 49561 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: CAG
gcctcccctgccattcagaa

SEQ ID NO: 49562 - DNA, 20 bp, synthetic construct
  source 1..20: mol_type = other DNA; note = Description of Artificial Sequence: Synthetic oligonucleotide; note = Target: SCN9A; (+) strand; PAM type: NRG; PAM sequence: GAG
cccctgccattcagaacagt
